United States Patent 12,415,844 (BCMA SPECIFIC VCAR COMPOSITIONS AND METHODS FOR USE) - sequence listing, part 3

SEQ ID NO: 9982 - protein, 720 aa, Homo Sapiens
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 9983 - protein, 416 aa, Homo Sapiens
MLKLAPWCLSFVTTPMFLVAMRKELASRMEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 9984 - protein, 1251 aa, Homo Sapiens
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGENFYYKHREAVVDGTPCEPGKRDVCVDGSCRVVGCDHELDSSKQEDKCLRCGGDGTTCYPVAGTFDANDLSRAVKNVRGEYYLNGHWTIEAARALPAASTILHYERGAEGDLAPERLHARGPTSEPLVIELISQEPNPGVHYEYHLPLRRPSPGFSWSHGSWSDCSAECGGGHQSRLVFCTIDHEAYPDHMCQRQPRPADRRSCNLHPCPETKRWKAGPWAPCSASCGGGSQSRSVYCISSDGAGIQEAVEEAECAGLPGKPPAIQACNLQRCAAWSPEPWGECSVSCGVGVRKRSVTCRGERGSLLHTAACSLEDRPPLTEPCVHEDCPLLSDQAWHVGTWGLCSKSCSSGTRRRQVICAIGPPSHCGSLQHSKPVDVEPCNTQPCHLPQEVPSMQDVHTPASNPWMPLGPQESPASDSRGQWWAAQEHPSARGDHRGERGDPRGDQGTHLSALGPAPSLQQPPYQQPLRSGSGPHDCRHSPHGCCPDGHTASLGPQWQGCPGAPCQQSRYGCCPDRVSVAEGPHHAGCTKSYGGDSTGGMPRSRAVASTVHNTHQPQAQQNEPSECRGSQFGCCYDNVATAAGPLGEGCVGQPSHAYPVRCLLPSAHGSCADWAARWYFVASVGQCNRFWYGGCHGNANNFASEQECMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRISLAGVEPSLVQAALGQLVRLSCSDDTAPESQAAWQKDGQPISSDRHRLQFDGSLIIHPLQAEDAGTYSCGSTRPGRDSQKIQLRIIGGDMAVLSEAELSRFPQPRDPAQDFGQAGAAGPLGAIPSSHPQPANRLRLDQNQPRVVDASPGQRIRMTCRAEGFPPPAIEWQRDGQPVSSPRHQLQPDGSLVISRVAVEDGGFYTCVAFNGQDRDQRWVQLRVLGELTISGLPPTVTVPEGDTARLLCVVAGESVNIRWSRNGLPVQADGHRVHQSPDGTLLIYNLRARDEGSYTCSAYQGSQAVSRSTEVKVVSPAPTAQPRDPGRDCVDQPELANCDLILQAQLCGNEYYSSFCCASCSRFQPHAQPIWQ

SEQ ID NO: 9985 - protein, 929 aa, Homo Sapiens
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGENFYYKHREAVVDGTPCEPGKRDVCVDGSCRVVGCDHELDSSKQEDKCLRCGGDGTTCYPVAGTFDANDLSRAVKNVRGEYYLNGHWTIEAARALPAASTILHYERGAEGDLAPERLHARGPTSEPLVIELISQEPNPGVHYEYHLPLRRPSPGFSWSHGSWSDCSAECGGGHQSRLVFCTIDHEAYPDHMCQRQPRPADRRSCNLHPCPETKRWKAGPWAPCSASCGGGSQSRSVYCISSDGAGIQEAVEEAECAGLPGKPPAIQACNLQRCAAWSPEPWGECSVSCGVGVRKRSVTCRGERGSLLHTAACSLEDRPPLTEPCVHEDCPLLSDQAWHVGTWGLCSKSCSSGTRRRQVICAIGPPSHCGSLQHSKPVDVEPCNTQPCHLPQEVPSMQDVHTPASNPWMPLGPQESPASDSRGQWWAAQEHPSARGDHRGERGDPRGDQGTHLSALGPAPSLQQPPYQQPLRSGSGPHDCRHSPHGCCPDGHTASLGPQWQGCPGAPCQQSRYGCCPDRVSVAEGPHHAGCTKSYGGDSTGGMPRSRAVASTVHNTHQPQAQQNEPSECRGSQFGCCYDNVATAAGPLGEGCVGQPSHAYPVRCLLPSAHGSCADWAARWYFVASVGQCNRFWYGGCHGNANNFASEQECMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRISLAGVEPSLVQAALGQLVRLSCSDDTAPESQAAWQKDGQPISSDRFT

SEQ ID NO: 9986 - protein, 808 aa, Homo Sapiens
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGENFYYKHREAVVDGTPCEPGKRDVCVDGSCRVVGCDHELDSSKQEDKCLRCGGDGTTCYPVAGTFDANDLSRGYNQILIVPMGATSILIDEAAASRNFLAVKNVRGEYYLNGHWTIEAARALPAASTILHYERGAEGDLAPERLHARGPTSEPLVIELISQEPNPGVHYEYHLPLRRPSPGFSWSHGSWSDCSAECGGGHQSRLVFCTIDHEAYPDHMCQRQPRPADRRSCNLHPCPETKRWKAGPWAPCSASCGGGSQSRSVYCISSDGAGIQEAVEEAECAGLPGKPPAIQACNLQRCAAWSPEPWGECSVSCGVGVRKRSVTCRGERGSLLHTAACSLEDRPPLTEPCVHEDCPLLSDQAWHVGTWGLCSKSCSSGTRRRQVICAIGPPSHCGSLQHSKPVDVEPCNTQPCHLPQEVPSMQDVHTPASNPWMPLGPQESPASDSRGQWWAAQEHPSARGDHRGERGDPRGDQGTHLSALGPAPSLQQPPYQQPLRSGSGPHDCRHSPHGCCPDGHTASLGPQWQGCPGAPCQQSRYGCCPDRVSVAEGPHHAGCTKSYGGDSTGGMPRSRAVASTVHNTHQPQAQQNEPSECRGSQFGCCYDNVATAAGPLGEGCVGQPSHGLAWQVWSPRWCRQPWGSWCGSPAQTTLPRNPRLPGRKMASPSPLTGVCDGPPTSSDRCV

SEQ ID NO: 9987 - protein, 1262 aa, Homo Sapiens
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGENFYYKHREAVVDGTPCEPGKRDVCVDGSCRVVGCDHELDSSKQEDKCLRCGGDGTTCYPVAGTFDANDLSRGYNQILIVPMGATSILIDEAAASRNFLAVKNVRGEYYLNGHWTIEAARALPAASTILHYERGAEGDLAPERLHARGPTSEPLVIELISQEPNPGVHYEYHLPLRRPSPGFSWSHGSWSDCSAECGGGHQSRLVFCTIDHEAYPDHMCQRQPRPADRRSCNLHPCPETKRWKAGPWAPCSASCGGGSQSRSVYCISSDGAGIQEAVEEAECAGLPGKPPAIQACNLQRCAAWSPEPWGECSVSCGVGVRKRSVTCRGERGSLLHTAACSLEDRPPLTEPCVHEDCPLLSDQAWHVGTWGLCSKSCSSGTRRRQVICAIGPPSHCGSLQHSKPVDVEPCNTQPCHLPQEVPSMQDVHTPASNPWMPLGPQESPASDSRGQWWAAQEHPSARGDHRGERGDPRGDQGTHLSALGPAPSLQQPPYQQPLRSGSGPHDCRHSPHGCCPDGHTASLGPQWQGCPGAPCQQSRYGCCPDRVSVAEGPHHAGCTKSYGGDSTGGMPRSRAVASTVHNTHQPQAQQNEPSECRGSQFGCCYDNVATAAGPLGEGCVGQPSHDWAARWYFVASVGQCNRFWYGGCHGNANNFASEQECMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRISLAGVEPSLVQAALGQLVRLSCSDDTAPESQAAWQKDGQPISSDRHRLQFDGSLIIHPLQAEDAGTYSCGSTRPGRDSQKIQLRIIGGDMAVLSEAELSRFPQPRDPAQDFGQAGAAGPLGAIPSSHPQPANRLRLDQNQPRVVDASPGQRIRMTCRAEGFPPPAIEWQRDGQPVSSPRHQLQPDGSLVISRVAVEDGGFYTCVAFNGQDRDQRWVQLRVLGELTISGLPPTVTVPEGDTARLLCVVAGESVNIRWSRNGLPVQADGHRVHQSPDGTLLIYNLRARDEGSYTCSAYQGSQAVSRSTEVKVVSPAPTAQPRDPGRDCVDQPELANCDLILQAQLCGNEYYSSFCCASCSRFQPHAQPIWQ

SEQ ID NO: 9988 - protein, 1278 aa, Homo Sapiens
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGENFYYKHREAVVDGTPCEPGKRDVCVDGSCRVVGCDHELDSSKQEDKCLRCGGDGTTCYPVAGTFDANDLSRGYNQILIVPMGATSILIDEAAASRNFLAVKNVRGEYYLNGHWTIEAARALPAASTILHYERGAEGDLAPERLHARGPTSEPLVIELISQEPNPGVHYEYHLPLRRPSPGFSWSHGSWSDCSAECGGGHQSRLVFCTIDHEAYPDHMCQRQPRPADRRSCNLHPCPETKRWKAGPWAPCSASCGGGSQSRSVYCISSDGAGIQEAVEEAECAGLPGKPPAIQACNLQRCAAWSPEPWGECSVSCGVGVRKRSVTCRGERGSLLHTAACSLEDRPPLTEPCVHEDCPLLSDQAWHVGTWGLCSKSCSSGTRRRQVICAIGPPSHCGSLQHSKPVDVEPCNTQPCHLPQEVPSMQDVHTPASNPWMPLGPQESPASDSRGQWWAAQEHPSARGDHRGERGDPRGDQGTHLSALGPAPSLQQPPYQQPLRSGSGPHDCRHSPHGCCPDGHTASLGPQWQGCPGAPCQQSRYGCCPDRVSVAEGPHHAGCTKSYGGDSTGGMPRSRAVASTVHNTHQPQAQQNEPSECRGSQFGCCYDNVATAAGPLGEGCVGQPSHAYPVRCLLPSAHGSCADWAARWYFVASVGQCNRFWYGGCHGNANNFASEQECMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRISLAGVEPSLVQAALGQLVRLSCSDDTAPESQAAWQKDGQPISSDRHRLQFDGSLIIHPLQAEDAGTYSCGSTRPGRDSQKIQLRIIGGDMAVLSEAELSRFPQPRDPAQDFGQAGAAGPLGAIPSSHPQPANRLRLDQNQPRVVDASPGQRIRMTCRAEGFPPPAIEWQRDGQPVSSPRHQLQPDGSLVISRVAVEDGGFYTCVAFNGQDRDQRWVQLRVLGELTISGLPPTVTVPEGDTARLLCVVAGESVNIRWSRNGLPVQADGHRVHQSPDGTLLIYNLRARDEGSYTCSAYQGSQAVSRSTEVKVVSPAPTAQPRDPGRDCVDQPELANCDLILQAQLCGNEYYSSFCCASCSRFQPHAQPIWQ

SEQ ID NO: 9989 - protein, 1278 aa, Homo Sapiens; identical to SEQ ID NO: 9988

SEQ ID NO: 9990 - protein, 214 aa, Homo Sapiens
VHNTHQPQAQQNEPSECRGSQFGCCYDNVATAAGPLGEGCVGQPSHAYPVRCLLPSAHGSCADWAARWYFVASVGQCNRFWYGGCHGNANNFASEQECMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRSHFPPLQD

SEQ ID NO: 9991 - protein, 311 aa, Homo Sapiens
  misc_feature (1)..(1): Xaa can be any naturally occurring amino acid
XCMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRISLAGVEPSLVQAALGQLVRLSCSDDTAPESQAAWQKDGQPISSDRHRLQFDGSLIIHPLQAEDAGTYSCGSTRPGRDSQKIQLRIIGGDMAVLSEAELSRFPQPRDPAQDFGQAGAAGPLGAIPSSHPQPANRLRLDQNQPRVVDASPGQRIRMTCRAEGFPPPAIEWQRDGQPVSSPSTHRPAQGPWQGLRRPARAGQL

SEQ ID NO: 9992 - protein, 1627 aa, Homo Sapiens
MRLWSWVLHLGLLSAALGCGLAERPRRARRDPRAGRPPRPAAGPATCATRAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISQHAWYPCTISYPYSQLAQTTFWLRAYFSQPMVAAAVIVHLVTDGTYYGDQKQETISVQLLDTKDQSHDLGLHVLSCRNNPLIIPVVHDLSQPFYHSQAVRVSFSSPLVAISGVALRSFDNFDPVTLSSCQRGETYSPAEQSCVHFACEKTDCPELAVENASLNCSSSDRYHGAQCTVSCRTGYVLQIRRDDELIKSQTGPSVTVTCTEGKWNKQVACEPVDCSIPDHHQVYAASFSCPEGTTFGSQCSFQCRHPAQLKGNNSLLTCMEDGLWSFPEALCELMCLAPPPVPNADLQTARCRENKHKVGSFCKYKCKPGYHVPGSSRKSKKRAFKTQCTQDGSWQEGACVPVTCDPPPPKFHGLYQCTNGFQFNSECRIKCEDSDASQGLGSNVIHCRKDGTWNGSFHVCQEMQGQCSVPNELNSNLKLQCPDGYAIGSECATSCLDHNSESIILPMNVTVRDIPHWLNPTRVERVVCTAGLKWYPHPALIHCVKGCEPFMGDNYCDAINNRAFCNYDGGDCCTSTVKTKKVTPFPMSCDLQGDCACRDPQAQEHSRKDLRGYSHG

SEQ ID NO: 9993 - protein, 827 aa, Homo Sapiens
MMCLKILRISLAILAGWALCSANSELGWTRKKSLVEREHLNQVLLEGERCWLGAKVRRPRASPQHHLFGVYPSRAGNYLRPYPVGEQEIHHTGRSKPDTEGNAVSLVPPDLTENPAGLRGAVEEPAAPWVGDSPIGQSELLGDDDAYLGNQRSKESLGEAGIQKGSAMAATTTTAIFTTLNEPKPETQRRGWAKSRQRRQVWKRRAEDGQGDSGISSHFQPWPKHSLKHRVKKSPPEESNQNGGEGSYREAETFNSQVGLPILYFSGRRERLLLRPEVLAEIPREAFTVEAWVKPEGGQNNPAIIAGVFDNCSHTVSDKGWALGIRSGKDKGKRDARFFFSLCTDRVKKATILISHSRYQPGTWTHVAATYDGRHMALYVDGTQVASSLDQSGPLNSPFMASCRSLLLGGDSSEDGHYFRGHLGTLVFWSTALPQSHFQHSSQHSSGEEEATDLVLTASFEPVNTEWVPFRDEKYPRLEVLQGFEPEPEILSPLQPPLCGQTVCDNVELISQYNGYWPLRGEKVIRYQVVNICDDEGLNPIVSEEQIRLQHEALNEAFSRYNISWQLSVHQVHNSTLRHRVVLVNCEPSKIGNDHCDPECEHPLTGYDGGDCRLQGRCYSWNRRDGLCHVECNNMLNDFDDGDCCDPQVADVRKTCFDPDSPKRAYMSVKELKEALQLNSTHFLNIYFASSVREDLAGAATWPWDKDAVTHLGGIVLSPAYYGMPGHTDTMIHEVGHVLGLYHVFKGVSERESCNDPCKETVPSMETGDLCADTAPTPKSELCREPEPTSDTCGFTRFPGAPFTNYMSYTGITTVLFCFLLRIHGGL

SEQ ID NO: 9994 - protein, 1791 aa, Homo Sapiens
MMCLKILRISLAILAGWALCSANSELGWTRKKSLVEREHLNQVLLEGERCWLGAKVRRPRASPQHHLFGVYPSRAGNYLRPYPVGEQEIHHTGRSKPDTEGNAVSLVPPDLTENPAGLRGAVEEPAAPWVGDSPIGQSELLGDDDAYLGNQRSKESLGEAGIQKGSAMAATTTTAIFTTLNEPKPETQRRGWAKSRQRRQVWKRRAEDGQGDSGISSHFQPWPKHSLKHRVKKSPPEESNQNGGEGSYREAETFNSQVGLPILYFSGRRERLLLRPEVLAEIPREAFTVEAWVKPEGGQNNPAIIAGVFDNCSHTVSDKGWALGIRSGKDKGKRDARFFFSLCTDRVKKATILISHSRYQPGTWTHVAATYDGRHMALYVDGTQVASSLDQSGPLNSPFMASCRSLLLGGDSSEDGHYFRGHLGTLVFWSTALPQSHFQHSSQHSSGEEEATDLVLTASFEPVNTEWVPFRDEKYPRLEVLQGFEPEPEILSPLQPPLCGQTVCDNVELISQYNGYWPLRGEKVIRYQVVNICDDEGLNPIVSEEQIRLQHEALNEAFSRYNISWQLSVHQVHNSTLRHRVVLVNCEPSKIGNDHCDPECEHPLTGYDGGDCRLQGRCYSWNRRDGLCHVECNNMLNDFDDGDCCDPQVADVRKTCFDPDSPKRAYMSVKELKEALQLNSTHFLNIYFASSVREDLAGAATWPWDKDAVTHLGGIVLSPAYYGMPGHTDTMIHEVGHVLGLYHVFKGVSERESCNDPCKETVPSMETGDLCADTAPTPKSELCREPEPTSDTCGFTRFPGAPFTNYMSYTDDNCTDNFTPNQVARMHCYLDLVYQQWTESRKPTPIPIPPMVIGQTNKSLTIHWLPPISGVVYDRASGSLCGACTEDGTFRQYVHTASSRRVCDSSGYWTPEEAVGPPDVDQPCEPSLQAWSPEVHLYHMNMTVPCPTEGCSLELLFQHPVQADTLTLWVTSFFMESSQVLFDTEILLENKESVHLGPLDTFCDIPLTIKLHVDGKVSGVKVYTFDERIEIDAALLTSQPHSPLCSGCRPVRYQVLRDPPFASGLPVVVTHSHRKFTDVEVTPGQMYQYQVLAEAGGELGEASPPLNHIHGAPYCGDGKVSERLGEECDDGDLVSGDGCSKVCELEEGFNCVGEPSLCYMYEGDGICEPFERKTSIVDCGIYTPKGYLDQWATRAYSSHEDKKKCPVSLVTGEPHSLICTSYHPDLPNHRPLTGWFPCVASENETQDDRSEQPEGSLKKEDEVWLKVCFNRPGEARAIFIFLTTDGLVPGEHQQPTVTLYLTDVRGSNHSLGTYGLSCQHNPLIINVTHHQNVLFHHTTSVLLNFSSPRVGISAVALRTSSRIGLSAPSNCISEDEGQNHQGQSCIHRPCGKQDSCPSLLLDHADVVNCTSIGPGLMKCAITCQRGFALQASSGQYIRPMQKEILLTCSSGHWDQNVSCLPVDCGVPDPSLVNYANFSCSEGTKFLKRCSISCVPPAKLQGLSPWLTCLEDGLWSLPEVYCKLECDAPPIILNANLLLPHCLQDNHDVGTICKYECKPGYYVAESAEGKVRNKLLKIQCLEGGIWEQGSCIPVVCEPPPPVFEGMYECTNGFSLDSQCVLNCNQEREKLPILCTKEGLWTQEFKLCENLQGECPPPPSELNSVEYKCEQGYGIGAVCSPLCVIPPSDPVMLPENITADTLEHWMEPVKVQSIVCTGRRQWHPDPVLVHCIQSCEPFQADGWCDTINNRAYCHYDGGDCCSSTLSSKKVIPFAADCDLDECTCRDPKAEENQ

SEQ ID NO: 9995 - protein, 678 aa, Homo Sapiens
MAAPGPLPAAALSPGAPTPRELMHGVAGVTSRAGRDREAGSVLPAGNRGARKASRRSSSRSMSRDNKFSKKDCLSIRNVVASIQTKEGLNLKLISGDVLYIWADVIVNSVPMNLQLGGGPLSRAFLQKAGPMLQKELDDRRRETEEKVGNIFMTSGCNLDCKAVLHAVAPYWNNGAETSWQIMANIIKKCLTTVEVLSFSSITFPMIGTGSLQFPKAVFAKLILSEVFEYSSSTRPITSPLQEVHFLVYTNDDEGCQAFLDEFTNWSRINPNKARIPMAGDTQGVVGTVSKPCFTAYEMKIGAITFQVATGDIATEQVDVIVNSTARTFNRKSGVSRAILEGAGQAVESECAVLAAQPHRDFIITPGGCLKCKIIIHVPGGKDVRKTVTSVLEECEQRKYTSVSLPAIGTGNAGKNPITVADNIIDAIVDFSSQHSTPSLKTVKVVIFQPELLNIFYDSMKKRDLSASLNFQSTFSMTTCNLPEHWTDMNHQLFCMVQLEPGQSEYNTIKDKFTRTCSSYAIEKIERIQNAFLWQSYQVKKRQMDIKNDHKNNERLLFHGTDADSVPYVNQHGFNRSCAGKNAVSYGKGTYFAVDASYSAKDTYSKPDSNGRKHMYVVRVLTGVFTKGRAGLVTPPPKNPHNPTDLFDSVTNNTRSPKLFVVFFDNQAYPEYLITFTA

SEQ ID NO: 9996 - protein, 483 aa, Homo Sapiens
MAAPGPLPAAALSPGAPTPRELMHGVAGVTSRAGRDREAGSVLPAGNRGARKASRRSSSRSMSRDNKFSKKDCLSIRNVVASIQTKEGLNLKLISGDVLYIWADVIVNSVPMNLQLGGGPLSRAFLQKAGPMLQKELDDRRRETEEKVGNIFMTSGCNLDCKAVLHAVAPYWNNGAETSWQVATGDIATEQVDVIVNSTARTFNRKSGVSRAILEGAGQAVESECAVLAAQPHRDFIITPGGCLKCKIIIHVPGGKDVRKTVTSVLEECEQRKYTSVSLPAIGTGNLPEHWTDMNHQLFCMVQLEPGQSEYNTIKDKFTRTCSSYAIEKIERIQNAFLWQSYQVKKRQMDIKNDHKNNERLLFHGTDADSVPYVNQHGFNRSCAGKNAVSYGKGTYFAVDASYSAKDTYSKPDSNGRKHMYVVRVLTGVFTKGRAGLVTPPPKNPHNPTDLFDSVTNNTRSPKLFVVFFDNQAYPEYLITFTA

SEQ ID NO: 9997 - protein, 444 aa, Homo Sapiens
MLQRIGLIFLHNIVVVSNCFYFQAFLDEFTNWSRINPNKARIPMAGDTQGVVGTVSKPCFTAYEMKIGAITFQVATGDIATEQVDVIVNSTARTFNRKSGVSRAILEGAGQAVESECAVLAAQPHRDFIITPGGCLKCKIIIHVPGGKDVRKTVTSVLEECEQRKYTSVSLPAIGTGNAGKNPITVADNIIDAIVDFSSQHSTPSLKTVKVVIFQPELLNIFYDSMKKRDLSASLNFQSTFSMTTCNLPEHWTDMNHQLFCMVQLEPGQSEYNTIKDKFTRTCSSYAIEKIERIQNAFLWQSYQVKKRQMDIKNDHKNNERLLFHGTDADSVPYVNQHGFNRSCAGKNAVSYGKGTYFAVDASYSAKDTYSKPDSNGRKHMYVVRVLTGVFTKGRAGLVTPPPKNPHNPTDLFDSVTNNTRSPKLFVVFFDNQAYPEYLITFTA

SEQ ID NO: 9998 - protein, 375 aa, Homo Sapiens
MLQRIGLIFLHNIVVVSNCFYFQAFLDEFTNWSRINPNKARIPMAGDTQGVVGTVSKPCFTAYEMKIGAITFQVATGDIATEQVDVIVNSTARTFNRKSGVSRAILEGAGQAVESECAVLAAQPHRDFIITPGGCLKCKIIIHVPGGKDVRKTVTSVLEECEQRKYTSVSLPAIGTGNLPEHWTDMNHQLFCMVQLEPGQSEYNTIKDKFTRTCSSYAIEKIERIQNAFLWQSYQVKKRQMDIKNDHKNNERLLFHGTDADSVPYVNQHGFNRSCAGKNAVSYGKGTYFAVDASYSAKDTYSKPDSNGRKHMYVVRVLTGVFTKGRAGLVTPPPKNPHNPTDLFDSVTNNTRSPKLFVVFFDNQAYPEYLITFTA

SEQ ID NO: 9999 - protein, 397 aa, Homo Sapiens
MHHVFKDHQRGEKRGFLSPENKNCRRLELRRGCSCSWGLCSQALMASLAGSLLPGSDRSGVETSEYAQGGVSDLQEEGKNAINSPMSPALVDVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKSLITFVNKHLNKLNLEVTELETQFADGVYLVLLMGLLEDYFVPLHHFYLTPESFDQKVHNVSFAFELMLDGGLKKPKARPEDVVNLDLKSTLRVLYNLFTKYKNVE

SEQ ID NO: 10000 - protein, 194 aa, Homo Sapiens
MPRLKCSGAVIAHCSLELLASSDPSASASQGARTTVSDLQEEGKNAINSPMSPALVDVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAP

SEQ ID NO: 10001 - protein, 327 aa, Homo Sapiens
MSDLQEEGKNAINSPMSPALVDVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKSLITFVNKHLNKLNLEVTELETQFADGVYLVLLMGLLEDYFVPLHHFYLTPESFDQKVHNVSFAFELMLDGGLKKPKARPEDVVNLDLKSTLRVLYNLFTKYKNVE

SEQ ID NO: 10002 - protein, 289 aa, Homo Sapiens
MSPALVDVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKFADGVYLVLLMGLLEDYFVPLHHFYLTPESFDQKVHNVSFAFELMLDGGLKKPKARPEDVVNLDLKSTLRVLYNLFTKYKNVE

SEQ ID NO: 10003 - protein, 364 aa, Homo Sapiens
MSSAPRSPTPRPRRMKKDESFLGKLGGTLARKRRAREVSDLQEEGKNAINSPMSPALVDVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKSLITFVNKHLNKLNLEVTELETQFADGVYLVLLMGLLEDYFVPLHHFYLTPESFDQKVHNVSFAFELMLDGGLKKPKARPEDVVNLDLKSTLRVLYNLFTKYKNVE

SEQ ID NO: 10004 - protein, 114 aa, Homo Sapiens
MDKSLLLELPILLCCFRALSGSLSMRNDAVIEIVQCRMCHLQFPGEKCSRGRGICTATTEEACMVGRMFKRDGNPWLTFMGCLKNCADVKGIRWSVYLVNFRCCRSHDLCNEDL

SEQ ID NO: 10005 - protein, 126 aa, Homo Sapiens
MDKSLLLELPILLCCFRALSGSLSMRNDAVNEIVAVKNNFPVIEIVQCRMCHLQFPGEKCSRGRGICTATTEEACMVGRMFKRDGNPWLTFMGCLKNCADVKGIRWSVYLVNFRCCRSHDLCNEDL

SEQ ID NO: 10006 - protein, 113 aa, Homo Sapiens
MLVLFLLGTVFLLCPYWGELHDPIKATEIMCYECKKYHLGLCYGVMTSCSLKHKQSCAVENFYILTRKGQSMYHYSKLSCMTSCEDINFLGFTKRVELICCDHSNYCNLPEGV

SEQ ID NO: 10007 - protein, 70 aa, Homo Sapiens
MLVLFLLGTVFLLCPYWGELHDPIKGQSMYHYSKLSCMTSCEDINFLGFTKRVELICCDHSNYCNLPEGV

SEQ ID NO: 10008 - protein, 98 aa, Homo Sapiens
MNKHFLFLFLLYCLIVAVTSLQCITCHLRTRTDRCRRGFGVCTAQKGEACMLLRIYQRNTLQISYMVCQKFCRDMTFDLRNRTYVHTCCNYNYCNFKL

SEQ ID NO: 10009 - protein, 59 aa, Homo Sapiens
MRKMNTLLLVSLSFLYLKEGDKHMYSTHMCKYKCREEESSKRGLLRVTLCCDRNFCNVF

SEQ ID NO: 10010 - protein, 98 aa, Homo Sapiens
MRKMNTLLLVSLSFLYLKEVMGLKCNTCIYTEGWKCMAGRGTCIAKENELCSTTAYFRGDKHMYSTHMCKYKCREEESSKRGLLRVTLCCDRNFCNVF

SEQ ID NO: 10011 - protein, 125 aa, Homo Sapiens
MLGMSLASLHFLWQTLDYLSPIPFWPTFPSTSSPAQHFGPRLPSPDPTLFCSLLTSWPPRFSHLTQLHPRHQRILQQQQHSQTPREPHFLLTTLLRKCQWWVSLKGCSSWLKVPQPRSLGLSSQT

SEQ ID NO: 10012 - protein, 543 aa, Homo Sapiens
MNCLEGPGKTCGPLASEEELVSACQLEKEEENEGEEEEEEEDEEDLDPDLDPDLEEEENDLGDPAVLGAVHNTQRALLSSPGVKAPGMLGMSLASLHFLWQTLDYLSPIPFWPTFPSTSSPAQHFGPRLPSPDPTLFCSLLTSWPPRFSHLTQLHPRHQRILQQQQHSQTPSPPAKKPWSQQPDPYANLMTRKEKDWVIKVQMVQLQSAKPRLDDYYYQEYYQKLEKKQADEELLGRRNRVESLKLVTPYIPKAEAYESVVRIEGSLGQVAVSTCFSPRRAIDAVPHGTQEQDIEAASSQRLRVLYRIEKMFLQLLEIEEGWKYRPPPPCFSEQQSNQVEKLFQTLKTQEQNNLEEAADGFLQVLSVRKGKALVARLLPFLPQDQAVTILLAITHHLPLLVRRDVADQALQMLFKPLGKCISHLTLHELLQGLQGLTLLPPGSSERPVTVVLQNQFGISLLYALLSHGEQLVSLHSSLEEPNSDHTAWTDMVVLIAWEIAQMPTASLAEPLAFPSNLLPLFCHHVDKQLVQQLEARMEFAWIY

SEQ ID NO: 10013 - protein, 543 aa, Homo Sapiens; identical to SEQ ID NO: 10012

SEQ ID NO: 10014 - protein, 354 aa, Homo Sapiens
MTRKEKDWVIKVQMVQLQSAKPRLDDYYYQEYYQKLEKKQADEELLGRRNRVESLKLVTPYIPKAEAYESVVRIEGSLGQVAVSTCFSPRRAIDAVPHGTQEQDIEAASSQRLRVLYRIEKMFLQLLEIEEGWKYRPPPPCFSEQQSNQVEKLFQTLKTQEQNNLEEAADGFLQVLSVRKGKALVARLLPFLPQDQAVTILLAITHHLPLLVRRDVADQALQMLFKPLGKCISHLTLHELLQGLQGLTLLPPGSSERPVTVVLQNQFGISLLYALLSHGEQLVSLHSSLEEPNSDHTAWTDMVVLIAWEIAQMPTASLAEPLAFPSNLLPLFCHHVDKQLVQQLEARMEFAWIY

SEQ ID NO: 10015 - protein, 158 aa, Homo Sapiens
QALQMLFKPLGKCISHLTLHELLQGLQGLTLLPPGSSERPVTVVLQNQDRHGGSDCLGDSPNAYSLSGRTPSFPQQPTSPVLSPRGQTIGSAAGGQDGVCLDLLICLFWNTCMWEVESSDTSYIDYVYRDPESLKTFLMPLYIGEPFPIFISFLQKSK

SEQ ID NO: 10016 - protein, 188 aa, Homo Sapiens
  misc_feature (1)..(1): Xaa can be any naturally occurring amino acid
XENEGEEEEEEEDEEDLDPDLDPDLEEEENDLGDPAVLGAVHNTQRALLSSPGVKAPGMLGMSLASLHFLWQTLDYLSPIPFWPTFPSTSSPAQHFGPRLPSPDPTLFCSLLTSWPPRFSHLTQLHPRHQRILQQQQHSQTPREPHFLLTTLLRKCQWWVSLKGCSSWLKVPQPRSLGLSSQTPMLTS

SEQ ID NO: 10017 - protein, 304 aa, Homo Sapiens
MAGPCCVWGVVFFSCLSPAGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGR

SEQ ID NO: 10018 - protein, 396 aa, Homo Sapiens
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPEAAVGPSSSLMSKPGRKLAEVPPCVQPTGASSPATRTATPSTRPTTRLGDSATPPY

SEQ ID NO: 10019 - protein, 394 aa, Homo Sapiens
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRGSAPAAAAAAYDRH

SEQ ID NO: 10020 - protein, 214 aa, Homo Sapiens
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEVEVYTDPAH

SEQ ID NO: 10021 - protein, 417 aa, Homo Sapiens
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEVEVYTDPAHIRGGGGLHLVWTLRDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRGSAPAAAAAAYDRH

SEQ ID NO: 10022 - protein, 393 aa, Homo Sapiens
MDMHCKADPFSAMHRHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRGSAPAAAAAAYDRH

SEQ ID NO: 10023 - protein, 257 aa, Homo Sapiens
MAWSSKSWLCLIASSCPRDTLLPSAHHASPVPASHLTQVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQGPTVFMSRKY

SEQ ID NO: 10024 - protein, 257 aa, Homo Sapiens; identical to SEQ ID NO: 10023

SEQ ID NO: 10025 - protein, 341 aa, Homo Sapiens
MAWSSKSWLCLIASSCPRDTLLPSAHHASPVPASHLTQVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWGHLPPQPNSLDSGLLCLPCPSSHCHLASLSGSQALLWPGCPLLYGLE

SEQ ID NO: 10026 - protein, 348 aa, Homo Sapiens
MHQDGISSMNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWDCGSFLLPVIAPSCVDVAWPCLDASLAHHLIGGAGKATPTHFSH

SEQ ID NO: 10027 - protein, 349 aa, Homo Sapiens
MHQDGISSMNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWDCGSFLLPVIAPSCVDVAWPCLDASLAHHLIGGAGKATPTHFSHP

SEQ ID NO: 10028 - protein, 351 aa, Homo Sapiens
MHQDGISSMNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWGHLPPQPNSLDSGLLCLPCPSSHCHLASLSGSQALLWPGCPLLYGLE

SEQ ID NO: 10029 - protein, 343 aa, Homo Sapiens
MNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWGHLPPQPNSLDSGLLCLPCPSSHCHLASLSGSQALLWPGCPLLYGLE

SEQ ID NO: 10030 - protein, 423 aa, Homo Sapiens
MAAALRVAAVGARLSVLASGLRAAVRSLCSQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 10031 - protein, 192 aa, Homo Sapiens [sequence omitted]

SEQ ID NO: 10032 - protein, 516 aa, Homo Sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 10033 - protein, 539 aa, Homo Sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 10034 - protein, 559 aa, Homo Sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASDSISFTPWNYARRQYRPYFAGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 10035 - protein, 303 aa, Homo Sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSPTFCLWLH

SEQ ID NO: 10036 - protein, 550 aa, Homo Sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVRVQEVFHQVVQSGHRDGRGAVRW

SEQ ID NO: 10037 - protein, 405 aa, Homo Sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGLWRCL

SEQ ID NO: 10038 - protein, 520 aa, Homo Sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 10039 - protein, 570 aa, Homo Sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQIRASAMSPRLVSDSWTQAIHLPWPPKVLGLQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 10040 - protein, 559 aa, Homo Sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQQIIGWAQWLPLVISALWEAEDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 10041 - protein, 482 aa, Homo Sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 10042 - protein, 84 aa, Homo Sapiens
MFVEHRCADFGMAADKNKFPGDSVVTGRGRINGRLVYVFSQDFTVFGGSLSGAHAQKICKIMDQAITVGAPVIGLNDSGGARIQ

SEQ ID NO: 10043 - protein, 134 aa, Homo Sapiens
MFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMV

SEQ ID NO: 10044 - protein, 163 aa, Homo Sapiens
  misc_feature (1)..(1): Xaa can be any naturally occurring amino acid
XESSWPSEISWAAHFGEGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYS

SEQ ID NO: 10045 - protein, 1237 aa, Homo Sapiens
MDSGAGGRRCPEAALLILGPPRMEHLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQVKANDSDQGANAEIEYTFHQAPEVVRRLLRLDRNTGLITVQGPVDREDLSTLRFSVLAKDRGTNPKSARAQVVVTVKDMNDNAPTIEIRGIGLVTHQDGMANISEDVAEETAVALVQVSDRDEGENAAVTCVVAGDVPFQLRQASETGSDSKKKYFLQTTTPLDYEKVKDYTIEIVAVDSGNPPLSSTNSLKVQVVDVNDNAPVFTQSVTEVAFPENNKPGEVIAEITASDADSGSNAELVYSLEPEPAAKGLFTISPETGEIQVKTSLDREQRESYELKVVAADRGSPSLQGTATVLVNVLDCNDNDPKFMLSGYNFSVMENMPALSPVGMVTVIDGDKGENAQVQLSVEQDNGDFVIQNGTGTILSSLSFDREQQSTYTFQLKAVDGGVPPRSAYVGVTINVLDENDNAPYITAPSNTSHKLLTPQTRLGETVSQVAAEDFDSGVNAELIYSIAGGNPYGLFQIGSHSGAITLEKEIERRHHGLHRLVVKVSDRGKPPRYGTALVHLYVNETLANRTLLETLLGHSLDTPLDIDIAGDPEYERSKQRGNILFGVVAGVVAVALLIALAVLVRYCRQREAKSGYQAGKKETKDLYAPKPSGKASKGNKSKGKKSKSPKPVKPVEDEDEAGLQKSLKFNLMSDAPGDSPRIHLPLNYPPGSPDLGRHYRSNSPLPSIQLQPQSPSASKKHQVVQDLPPANTFVGTGDTTSTGSEQYSDYSYRTNPPKYPSKQLPHRRVTFSATSQAQELQDPSQHSYYDSGLEESETPSSKSSSGPRLGPLALPEDHYERTTPDGSIGEMEHPENDLRPLPDVAMTGTCTRECSEFGHSDTCWMPGQSSPSRRTKSSALKLSTFVPYQDRGGQEPAGAGSPSPPEDRNTKTAPVRLLPSYSAFSHSSHDSCKDSATLEEIPLTQTSDFPPAATPASAQTAKREIYL

SEQ ID NO: 10046 - protein, 1060 aa, Homo Sapiens
MDSGAGGRRCPEAALLILGPPRMEHLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQVKANDSDQGANAEIEYTFHQAPEVVRRLLRLDRNTGLITVQGPVDREDLSTLRFSVLAKDRGTNPKSARAQVVVTVKDMNDNAPTIEIRGIGLVTHQDGMANISEDVAEETAVALVQVSDRDEGENAAVTCVVAGDVPFQLRQASETGSDSKKKYFLQTTTPLDYEKVKDYTIEIVAVDSGNPPLSSTNSLKVQVVDVNDNAPVFTQSVTEVAFPENNKPGEVIAEITASDADSGSNAELVYSLEPEPAAKGLFTISPETGEIQVKTSLDREQRESYELKVVAADRGSPSLQGTATVLVNVLDCNDNDPKFMLSGYNFSVMENMPALSPVGMVTVIDGDKGENAQVQLSVEQDNGDFVIQNGTGTILSSLSFDREQQSTYTFQLKAVDGGVPPRSAYVGVTINVLDENDNAPYITAPSNTSHKLLTPQTRLGETVSQVAAEDFDSGVNAELIYSIAGGNPYGLFQIGSHSGAITLEKEIERRHHGLHRLVVKVSDRGKPPRYGTALVHLYVNETLANRTLLETLLGHSLDTPLDIDIAGDPEYERSKQRGNILFGVVAGVVAVALLIALAVLVRYCRQREAKSGYQAGKKETKDLYAPKPSGKASKGNKSKGKKSKSPKPVKPVEDEDEAGLQKSLKFNLMSDAPGDSPRIHLPLNYPPGSPDLGRHYRSNSPLPSIQLQPQSPSASKKHQVVQDLPPANTFVGTGDTTSTGSEQYSDYSYRTNPPKYPSKQVGQPFQLSTPQPLPHPYHGAIWTEVWE

SEQ ID NO: 10047 - protein, 382 aa, Homo Sapiens
MDSGAGGRRCPEAALLILGPPRMEHLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQLPHRRVTFSATSQAQELQDPSQHSYYDSGLEESETPSSKSSSGPRLGPLALPEDHYERTTPDGSIGEMEHPENEPAGRSRP

SEQ ID NO: 10048 - protein, 150 aa, Homo Sapiens
MEHLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPV

SEQ ID NO: 10049 - protein, 126 aa, Homo Sapiens
  misc_feature (1)..(1): Xaa can be any naturally occurring amino acid
XGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQSLVDWDLEKRLRKKRETDSRG

SEQ ID NO: 10050 - protein, 17 aa, Homo Sapiens
  misc_feature (1)..(1): Xaa can be any naturally occurring amino acid
XIQVRGPLRITVRVTHH

SEQ ID NO: 10051 - protein, 23 aa, Homo Sapiens
MMQLLQLLLGLLGPGGYLFLLGD

SEQ ID NO: 10052 - protein, 1184 aa, Homo Sapiens
MMQLLQLLLGLLGPGGYLFLLGDCQEVTTLTVKYQVSEEVPSGTVIGKLSQELGREERRRQAGAAFQVLQLPQALPIQVDSEEGLLSTGRRLDREQLCRQWDPCLVSFDVLATGDLALIHVEIQVLDINDHQPRFPKGEQELEISESASLRTRIPLDRALDPDTGPNTLHTYTLSPSEHFALDVIVGPDETKHAELIVVKELDREIHSFFDLVLTAYDNGNPPKSGTSLVKVNVLDSNDNSPAFAESSLALEIQEDAAPGTLLIKLTATDPDQGPNGEVEFFLSKHMPPEVLDTFSIDAKTGQVILRRPLDYEKNPAYEVDVQARDLGPNPIPAHCKVLIKVLDVNDNIPSIHVTWASQPSLVSEALPKDSFIALVMADDLDSGHNGLVHCWLSQELGHFRLKRTNGNTYMLLTNATLDREQWPKYTLTLLAQDQGLQPLSAKKQLSIQISDINDNAPVFEKSRYEVSTRENNLPSLHLITIKAHDADLGINGKVSYRIQDSPVAHLVAIDSNTGEVTAQRSLNYEEMAGFEFQVIAEDSGQPMLASSVSVWVSLLDANDNAPEVVQPVLSDGKASLSVLVNASTGHLLVPIETPNGLGPAGTDTPPLATHSSRPFLLTTIVARDADSGANGEPLYSIRSGNEAHLFILNPHTGQLFVNVTNASSLIGSEWELEIVVEDQGSPPLQTRALLRVMFVTSVDHLRDSARKPGALSMSMLTVICLAVLLGIFGLILALFMSICRTEKKDNRAYNCREAESTYRQQPKRPQKHIQKADIHLVPVLRGQAGEPCEVGQSHKDVDKEAMMEAGWDPCLQAPFHLTPTLYRTLRNQGNQGAPAESREVLQDTVNLLFNHPRQRNASRENLNLPEPQPATGQPRSRPLKVAGSPTGRLAGDQGSEEAPQRPPASSATLRRQRHLNGKVSPEKESGPRQILRSLVRLSVAAFAERNPVEELTVDSPPVQQISQLLSLLHQGQFQPKPNHRGNKYLAKPGGSRSAIPDTDGPSARAGGQTDPEQEEGPLDPEEDLSVKQLLEEELSSLLDPSTGLALDRLSAPDPAWMARLSLPLTTNYRDNVISPDAAATEEPRTFQTFGKAEAPELSPTGTRLASTFVSEMSSLLEMLLEQRSSMPVEAASEALRRLSVCGRTLSLDLATSAASGMKVQGDPGGKTGTEGKSRGSSSSSRCL

SEQ ID NO: 10053 - protein, 460 aa, Homo Sapiens
LVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMRGYGSEQQQLLRPSLLKPEELSMESGIDPGQEYGQDYYSYEHGYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 10054 - protein, 92 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQ

SEQ ID NO: 10055 - protein, 1915 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRQAECTKTARIQAALPAAKPAVPAPAPVAAPPPPPPPPPGAHLYEELGDSSILFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 10056 - protein, 1955 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSILFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 10057 - protein, 961 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPVSRRH

SEQ ID NO: 10058 - protein, 654 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQHGDSNLRESTGQGKH

SEQ ID NO: 10059 - protein, 1677 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 10060 - protein, 1957 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 10061 - protein, 1540 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSMNRNYPWSLELILARNMDKIITVMSMGMKCLNMGVAVDCYHQLDRRNMVRWLVKLRKNMRRKRKSQRKLKNQRLKLESLVRRKK

SEQ ID NO: 10062 - protein, 654 aa, Homo Sapiens; identical to SEQ ID NO: 10058

SEQ ID NO: 10063 - protein, 1783 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 10064 - protein, 1886 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERSTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 10065 - protein, 1676 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSMYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 10066 - protein, 650 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 10067 - protein, 981 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 10068 - protein, 329 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPDLGSLCSGTNSWCQGRSGVHWSSPAWRCLFPRRLHQM

SEQ ID NO: 10069 - protein, 719 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 10070 - protein, 1952 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRQAECTKTARIQAALPAAKPAVPAPAPVAAPPPPPPPPPGAHLYEELGDSSILFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 10071 - protein, 1539 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKNYPWSLELILARNMDKIITVMSMGMKCLNMGVAVDCYHQLDRRNMVRWLVKLRKNMRRKRKSQRKLKNQRLKLESLVRRKK

SEQ ID NO: 10072 - protein, 1675 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 10073 - protein, 1740 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSIWSFCWQLVICMRTCAIWRTLTRRGYGSEQQQLLRPSLLKPEELSMESGIDPGQEYGQDYYSYEHGYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 10074 - protein, 1888 aa, Homo Sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERSTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSILSSLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 10075 - protein, 1962 aa, Homo Sapiens
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 10076 - protein, 1789 aa, Homo Sapiens
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSMYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 10077 - protein, 1682 aa, Homo Sapiens
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 10078 - protein, 1964 aa, Homo Sapiens
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSILSSLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 10079 - protein, 1681 aa, Homo Sapiens
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSMYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 10080 - protein, 1790 aa, Homo Sapiens
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 10081 - protein, 72 aa, Homo Sapiens
MFRQFYLWTCLASGIILGSLFEICLGQYDDGTILVDNMLIKGTAGGPDPTIELSLKDNVDYWVLMDPVKQML

SEQ ID NO: 10082 - protein, 1932 aa, Homo Sapiens
MFRQFYLWTCLASGIILGSLFEICLGQYDDGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 10083 - protein, 1150 aa, Homo Sapiens
MPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKNYPWSLELILARNMDKIITVMSMGMKCLNMGVAVDCYHQLDRRNMVRWLVKLRKNMRRKRKSQRKLKNQRLKLESLVRRKK

SEQ ID NO: 10084 - protein, 416 aa, Homo Sapiens
MQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRGYGSEQQQLLRPSLLKPEELSMESGIDPGQEYGQDYYSYEHGYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 10085 - protein, 1360 aa, Homo Sapiens
  misc_feature (1)..(1): Xaa can be any naturally occurring amino acid
XHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSIWSFCWQLVICMRTCAIWRTLTRRGYGSEQQQLLRPSLLKPEELSMESGIDPGQEYGQDYYSYEHGYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 10086 - protein, 37 aa, Homo Sapiens
  misc_feature (1)..(1): Xaa can be any naturally occurring amino acid
XMKCLNMGVAVDCYHQLDRRNMVRWLVKLRKNMRRKR

SEQ ID NO: 10087 - protein, 807 aa, Homo Sapiens
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQVSARDAGVPPLGSNVTLQVFVLDENDNAPALLAPRVGGTIGAVSELVPRLVGAGHVVAKVRAVDADSGYNAWLSYELQPAAGGARIPFRVGLYTGEISTTRVLDEADLSRYRLLVLVKDHGEPALTATATVLVSLVESGQAPKASSRASVGVAGPEAALVDVNVYLIIAICAVSSLLVLTLLLYTALRCSVPPTEGAYVPGKPTLVCSSALGSWSNSQQRRQRVCSSEGPPKTDLMAFSPGLSPSLNTSERNEQPEANLDLSGNVSPTFEFWL

SEQ ID NO: 10088 - protein, 686 aa, Homo Sapiens
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10089 - protein, 950 aa, Homo Sapiens
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQVSARDAGVPPLGSNVTLQVFVLDENDNAPALLAPRVGGTIGAVSELVPRLVGAGHVVAKVRAVDADSGYNAWLSYELQPAAGGARIPFRVGLYTGEISTTRVLDEADLSRYRLLVLVKDHGEPALTATATVLVSLVESGQAPKASSRASVGVAGPEAALVDVNVYLIIAICAVSSLLVLTLLLYTALRCSVPPTEGAYVPGKPTLVCSSALGSWSNSQQRRQRVCSSEGPPKTDLMAFSPGLSPSLNTSERNEQPEANLDLSGNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10090 - protein, 948 aa, Homo Sapiens
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQVSARDGGVPPLGSNLTLQVFVLDENDNAPALLASPAGSAGGAVSELVLRSVVAGHVVAKVRAVDADSGYNAWLSYELQSAAVGARIPFRVGLYTGEISTTRALDETDSPRQRLLVLVKDHGEPSLTATATVLVSLVEGSQAPKASSRASVGVAPEVALVDVNVYLIIAICAVSSLLVLTLLLYTALRCSAAPTEGACGPVKPTLVCSSAVGSWSYSQQRRQRVCSGEGLPKADLMAFSPSLPPCPMVDVDGEDQSIGGDHSRKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10091 - protein, 844 aa, Homo Sapiens
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQVSARDGGVPPLGSNLTLQVFVLDENDNAPALLASPAGSAGGAVSELVLRSVVAGHVVAKVRAVDADSGYNAWLSYELQSAAVGARIPFRVGLYTGEISTTRALDETDSPRQRLLVLVKDHGEPSLTATATVLVSLVEGSQAPKASSRASVGVAPEVALVDVNVYLIIAICAVSSLLVLTLLLYTALRCSAAPTEGACGPVKPTLVCSSAVGSWSYSQQRRQRVCSGEGLPKADLMAFSPSLPPCPMVDVDGEDQSIGGDHSRKVGYYVFIFLLCFMNNIFSYRIFSNMYQNISFLSTFHLCLNISSDTFVI

SEQ ID NO: 10092 - protein, 685 aa, Homo Sapiens
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10093 - protein, 949 aa, Homo Sapiens
MFGFQRRGLGTPRLQLWLLLLEFWEVGSGQLHYSVSEEAKHGTFVGRIAQDLGLELAELVQRLFRVASKTHGDLLEVNLQNGILFVNSRIDREELCGQSAECSIHLEVIVDRPLQVFHVNVEVKDINDNPPVFSLREQKLLIAESKQSDSRFPLEGASDADIEENALLTYRLSKNEYFSLDSPTNGKQIKRLSLILKKSLDREKTPELNLLLTATDGGKPELTGTVRLLVQVLDVNDNDPEFDKSEYKVSLMENAAKETLVLKLNATDRDEGVNGEVTYSLMSIKPNGRHLFTLDQNNGEVRVNGTLDYEENKFYKIEVQATDKGTPPMAGHCTVWVEILDTNDNSPEVAVTSLSLPVREDAQPSTVIALISVSDRDSGVNGQVTCSLTPHVPFKLVSTFKNYYSLVLDSALDRENVWAYELVVTARDGGSPSLWATARVSVEVADVNDNAPAFAQPEYTVFVKENNPPGCHIFTVSARDADAQENALVSYSLVERRLGDRALSSYVSVHAESGKVYALQPLDHEELELLQFQVSARDAGVPPLSSNVTLQVFVLDENDNAPALLATQAGSAGGAVNKLVPRSVGAGHVVAKVRAVDADSGYNAWLSYELQPAAGGSRIPFRVGLYTGEISTTRALDEADSPRHRLLVLVKDHGEPALTATATVLVSLVESGQAPKASSRTLAGAASPEAALVDVNVYLIIAICVVSSLLVLTLLLYTALWWSATPTEGACAPGKPTLVCSRAVGSWSYSQQRRQRVCSEEGPPKTDLMAFSPSLPLGLNKEEEGERQEPGSNHPGQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10094 - protein, 810 aa, Homo Sapiens
MFGFQRRGLGTPRLQLWLLLLEFWEVGSGQLHYSVSEEAKHGTFVGRIAQDLGLELAELVQRLFRVASKTHGDLLEVNLQNGILFVNSRIDREELCGQSAECSIHLEVIVDRPLQVFHVNVEVKDINDNPPVFSLREQKLLIAESKQSDSRFPLEGASDADIEENALLTYRLSKNEYFSLDSPTNGKQIKRLSLILKKSLDREKTPELNLLLTATDGGKPELTGTVRLLVQVLDVNDNDPEFDKSEYKVSLMENAAKETLVLKLNATDRDEGVNGEVTYSLMSIKPNGRHLFTLDQNNGEVRVNGTLDYEENKFYKIEVQATDKGTPPMAGHCTVWVEILDTNDNSPEVAVTSLSLPVREDAQPSTVIALISVSDRDSGVNGQVTCSLTPHVPFKLVSTFKNYYSLVLDSALDRENVWAYELVVTARDGGSPSLWATARVSVEVADVNDNAPAFAQPEYTVFVKENNPPGCHIFTVSARDADAQENALVSYSLVERRLGDRALSSYVSVHAESGKVYALQPLDHEELELLQFQVSARDAGVPPLSSNVTLQVFVLDENDNAPALLATQAGSAGGAVNKLVPRSVGAGHVVAKVRAVDADSGYNAWLSYELQPAAGGSRIPFRVGLYTGEISTTRALDEADSPRHRLLVLVKDHGEPALTATATVLVSLVESGQAPKASSRTLAGAASPEAALVDVNVYLIIAICVVSSLLVLTLLLYTALWWSATPTEGACAPGKPTLVCSRAVGSWSYSQQRRQRVCSEEGPPKTDLMAFSPSLPLGLNKEEEGERQEPGSNHPGQVSFLQIPPIRKCM

SEQ ID NO: 10095 - protein, 199 aa, Homo Sapiens
  misc_feature (1)..(1): Xaa can be any naturally occurring amino acid
XVSSLLVLTLLLYTALWWSATPTEGACAPGKPTLVCSRAVGSWSYSQQRRQRVCSEEGPPKTDLMAFSPSLPLGLNKEEEGERQEPGSNHPGQPRQPNPDWRYSASLRAGMHSSVHLEEAGILRAGPGGPDQQWPTVSSATPEPEAGEVSPPVGAGVNSNSWTFKYGPGNPKQSGPEPKKQTQVSFLLRRKGEASQPRQ

SEQ ID NO: 10096 - protein, 803 aa, Homo Sapiens
MVFTPEDRLGKQCLLLPLLLLAAWKVGSGQLHYSVPEEAKHGTFVGRIAQDLGLELAELVPRLFRMASKDREDLLEVNLQNGILFVNSRIDREELCGRSAECSIHLEVIVDRPLQVFHVDVEVRDINDNPPLFPVEEQRVLIYESRLPDSVFPLEGASDADVGSNSILTYKLSSSEYFGLDVKINSDDNKQIGLLLKKSLDREEAPAHNLFLTATDGGKPELTGTVQLLVTVLDVNDNAPTFEQSEYEVRIFENADNGTTVIRLNASDRDEGANGAISYSFNSLVAAMVIDHFSIDRNTGEIVIRGNLDFEQENLYKILIDATDKGHPPMAGHCTVLVRILDKNDNVPEIALTSLSLPVREDAQFGTVIALISVNDLDSGANGQVNCSLTPHVPFKLVSTFKNYYSLVLDSALDRESVSAYELVVTARDGGSPSLWATASLSVEVADMNDNAPAFAQPEYTVFVKENNPPGCHIFTVSARDADAQENALVSYSLVERRVGERALSSYISVHAESGKVYALQPLDHEELELLQFQVSARDAGVPPLGSNVTLQVFVLDENDNAPALLAPRVGGTGGAVSELVPRSLGAGQVVAKVRAVDADSGYNAWLSYELQPPASSARFPFRVGLYTGEISTTRVLDEADSPRHRLLVLVKDHGEPALTATATVLVSLVESGQAPKASSRASVGAAGPEAALVDVNVYLIIAICAVSSLLVLTLLLYTALRCSAPPTEGACTADKPTLVCSSAVGSWSYSQQRRQRVCSGEGPPKMDLMAFSPSLSPCPIMMGKAENQDLNEDHDAKVSEFS

SEQ ID NO: 10097 - protein, 686 aa, Homo Sapiens
MVFTPEDRLGKQCLLLPLLLLAAWKVGSGQLHYSVPEEAKHGTFVGRIAQDLGLELAELVPRLFRMASKDREDLLEVNLQNGILFVNSRIDREELCGRSAECSIHLEVIVDRPLQVFHVDVEVRDINDNPPLFPVEEQRVLIYESRLPDSVFPLEGASDADVGSNSILTYKLSSSEYFGLDVKINSDDNKQIGLLLKKSLDREEAPAHNLFLTATDGGKPELTGTVQLLVTVLDVNDNAPTFEQSEYEVRIFENADNGTTVIRLNASDRDEGANGAISYSFNSLVAAMVIDHFSIDRNTGEIVIRGNLDFEQENLYKILIDATDKGHPPMAGHCTVLVRILDKNDNVPEIALTSLSLPVREDAQFGTVIALISVNDLDSGANGQVNCSLTPHVPFKLVSTFKNYYSLVLDSALDRESVSAYELVVTARDGGSPSLWATASLSVEVADMNDNAPAFAQPEYTVFVKENNPPGCHIFTVSARDADAQENALVSYSLVERRVGERALSSYISVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10098 - protein, 950 aa, Homo Sapiens
MVFTPEDRLGKQCLLLPLLLLAAWKVGSGQLHYSVPEEAKHGTFVGRIAQDLGLELAELVPRLFRMASKDREDLLEVNLQNGILFVNSRIDREELCGRSAECSIHLEVIVDRPLQVFHVDVEVRDINDNPPLFPVEEQRVLIYESRLPDSVFPLEGASDADVGSNSILTYKLSSSEYFGLDVKINSDDNKQIGLLLKKSLDREEAPAHNLFLTATDGGKPELTGTVQLLVTVLDVNDNAPTFEQSEYEVRIFENADNGTTVIRLNASDRDEGANGAISYSFNSLVAAMVIDHFSIDRNTGEIVIRGNLDFEQENLYKILIDATDKGHPPMAGHCTVLVRILDKNDNVPEIALTSLSLPVREDAQFGTVIALISVNDLDSGANGQVNCSLTPHVPFKLVSTFKNYYSLVLDSALDRESVSAYELVVTARDGGSPSLWATASLSVEVADMNDNAPAFAQPEYTVFVKENNPPGCHIFTVSARDADAQENALVSYSLVERRVGERALSSYISVHAESGKVYALQPLDHEELELLQFQVSARDAGVPPLGSNVTLQVFVLDENDNAPALLAPRVGGTGGAVSELVPRSLGAGQVVAKVRAVDADSGYNAWLSYELQPPASSARFPFRVGLYTGEISTTRVLDEADSPRHRLLVLVKDHGEPALTATATVLVSLVESGQAPKASSRASVGAAGPEAALVDVNVYLIIAICAVSSLLVLTLLLYTALRCSAPPTEGACTADKPTLVCSSAVGSWSYSQQRRQRVCSGEGPPKMDLMAFSPSLSPCPIMMGKAENQDLNEDHDAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10099 - protein, 458 aa, Homo Sapiens
MDVNDNAPEITVSSITSPIPENTPETVVMVFRIRDRDSGDNGKMVCSIPEDIPFVLKSSVNNYYTLETERPLDRESRAEYNITITVTDLGTPRLKTEHNITVLVSDVNDNAPAFTQTSYALFVRENNSPALHIGSISATDRDSGTNAQVNYSLLPSQDPHLPLASLVSINADNGHLFALRSLDYEALQGFQFRVGATDHGSPALSSEALVRVLVLDANDNSPFVLYPLQNGSAPCTELVPWAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAAPVGRCSVPEGPFPGHLVDVSGTGTLSQSYHYEVCVTGGSRSNKFKFLKPIIPNFLPQSTGSEVEENPPFQNNLGF

SEQ ID NO: 10100 - protein, 67 aa, Homo Sapiens
MENGGAGTLQIRQVLLFFVLLGMSQAGSETGNFLVMEELQSGSFVGNLAKTLGLEHLWILKQLSHTQ

SEQ ID NO: 10101 - protein, 795 aa, Homo Sapiens
MENGGAGTLQIRQVLLFFVLLGMSQAGSETGNFLVMEELQSGSFVGNLAKTLGLEVSELSSRGARVVSNDNKECLQLDTNTGDLLLREMLDREELCGSNEPCVLYFQVLMKNPTQFLQIELQVRDINDHSPVFLEKEMLLEIPENSPVGAVFLLESAKDLDVGINAVKSYTINPNSHFHVKIRVNPDNRKYPELVLDKALDYEERPELSFILTALDGGSPPRSGTALVRVVVVDINDNSPEFEQAFYEVKILENSILGSLVVTVSAWDLDSGTNSELSYTFSHASEDIRKTFEINQKSGDITLTAPLDFEAIESYSIIIQATDGGGLFGKSTVRIQVMDVNDNAPEITVSSITSPIPENTPETVVMVFRIRDRDSGDNGKMVCSIPEDIPFVLKSSVNNYYTLETERPLDRESRAEYNITITVTDLGTPRLKTEHNITVLVSDVNDNAPAFTQTSYALFVRENNSPALHIGSISATDRDSGTNAQVNYSLLPSQDPHLPLASLVSINADNGHLFALRSLDYEALQGFQFRVGATDHGSPALSSEALVRVLVLDANDNSPFVLYPLQNGSAPCTELVPWAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAAPVGRCSVPEGPFPGHLVDVSGTGTLSQSYHYEVCVTGGSRSNKFKFLKPIIPNFLPQSTGSEVEENPPFQNNLGF

SEQ ID NO: 10102 - protein, 935 aa, Homo Sapiens
MANRLQRGDRSRLLLLLCIFLGTLRGFRARQIRYSVPEETEKGSFVGNISKDLGLEPRELAKRGVRIVSRGKTQLFAVNPRSGSLITAGRIDREELCETVSSCFLNMELLVEDTLKIYGVEVEIIDINDNAPSFQEDEVEIKVSEHAIPGARFALPNARDPDVGVNSLQSYQLSPNNYFSLQLRGRTDGAKNPELVLEGSLDREKEAAHLLLLTALDGGDPIRKGAVPIRVVVLDVNDHIPMFTQSVYRVSVPENISSGTRVLMVNATDPDEGINGEVMYSFRNMESKASEIFQLDSQTGEVQVRGSLDFEKYRFYEMEIQGQDGGGLFTTTTMLITVVDVNDNAPEITITSSINSILENSPPGTVIALLNVQDQDSGENGQVSCFIPNHLPFKLEKTYGNYYKLITSRVLDRELVQSYNITLTATDQGSPPLSAETHVWLNVADDNDNPPVFPHSSYSAYIPENNPRGASIFSVTALDPDSKQNALVTYSLTDDTVQGVPLSSYVSINSNTGVLYALQSFDYEQFRDLELRVIARDSGDPPLSSNVSLSLFVLDQNDNAPEILYPALPTDGSTGVELAPRSAEPGYLVTKVVAVDKDSGQNAWLSYRLLKASEPGLFAVGEHTGEVRTARALLDRDALKQSLVVAVQDHGQPPLSATVTLTVAVADSIPEVLADLGSLESLANSETSDLSLYLVVAVAAVSCIFLVFVIVLLALRLWRWHKSRLLQASEGGLAGMPTSHFVGVDGVQAFLQTYSHEVSLIADSQKSHLIFPQPNYGDTLISQESCEKSEPLLIAEDSAIILGKCDPTSNQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 10103 - protein, 750 aa, Homo Sapiens
MANRLQRGDRSRLLLLLCIFLGTLRGFRARQIRYSVPEETEKGSFVGNISKDLGLEPRELAKRGVRIVSRGKTQLFAVNPRSGSLITAGRIDREELCETVSSCFLNMELLVEDTLKIYGVEVEIIDINDNAPSFQEDEVEIKVSEHAIPGARFALPNARDPDVGVNSLQSYQLSPNNYFSLQLRGRTDGAKNPELVLEGSLDREKEAAHLLLLTALDGGDPIRKGAVPIRVVVLDVNDHIPMFTQSVYRVSVPENISSGTRVLMVNATDPDEGINGEVMYSFRNMESKASEIFQLDSQTGEVQVRGSLDFEKYRFYEMEIQGQDGGGLFTTTTMLITVVDVNDNAPEITITSSINSILENSPPGTVIALLNVQDQDSGENGQVSCFIPNHLPFKLEKTYGNYYKLITSRVLDRELVQSYNITLTATDQGSPPLSAETHVWLNVADDNDNPPVFPHSSYSAYIPENNPRGASIFSVTALDPDSKQNALVTYSLTDDTVQGVPLSSYVSINSNTGVLYALQSFDYEQFRDLELRVIARDSGDPPLSSNVSLSLFVLDQNDNAPEILYPALPTDGSTGVELAPRSAEPGYLVTKVVAVDKDSGQNAWLSYRLLKASEPGLFAVGEHTGEQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 10104 - protein, 837 aa, Homo Sapiens
MANRLQRGDRSRLLLLLCIFLGTLRGFRARQIRYSVPEETEKGSFVGNISKDLGLEPRELAKRGVRIVSRGKTQLFAVNPRSGSLITAGRIDREELCETVSSCFLNMELLVEDTLKIYGVEVEIIDINDNAPSFQEDEVEIKVSEHAIPGARFALPNARDPDVGVNSLQSYQLSPNNYFSLQLRGRTDGAKNPELVLEGSLDREKEAAHLLLLTALDGGDPIRKGAVPIRVVVLDVNDHIPMFTQSVYRVSVPENISSGTRVLMVNATDPDEGINGEVMYSFRNMESKASEIFQLDSQTGEVQVRGSLDFEKYRFYEMEIQGQDGGGLFTTTTMLITVVDVNDNAPEITITSSINSILENSPPGTVIALLNVQDQDSGENGQVSCFIPNHLPFKLEKTYGNYYKLITSRVLDRELVQSYNITLTATDQGSPPLSAETHVWLNVADDNDNPPVFPHSSYSAYIPENNPRGASIFSVTALDPDSKQNALVTYSLTDDTVQGVPLSSYVSINSNTGVLYALQSFDYEQFRDLELRVIARDSGDPPLSSNVSLSLFVLDQNDNAPEILYPALPTDGSTGVELAPRSAEPGYLVTKVVAVDKDSGQNAWLSYRLLKASEPGLFAVGEHTGEVRTARALLDRDALKQSLVVAVQDHGQPPLSATVTLTVAVADSIPEVLADLGSLESLANSETSDLSLYLVVAVAAVSCIFLVFVIVLLALRLWRWHKSRLLQASEGGLAGMPTSHFVGVDGVQAFLQTYSHEVSLIADSQKSHLIFPQPNYGDTLISQESCEKSEPLLIAEDSAIILGKCDPTSNQVRFISLPPNCWCLGTSLLRRCFLSLL

SEQ ID NO: 10105 - protein, 198 aa, Homo Sapiens
MLTCLVLSGVAQPVAFGQGQQFLPVHPQNPGFVQNPSGALPKAYPDNHLSQVDVNELFSKLLKTGILKLSQTDSATTQVSEVTAQPPPEEEEDQNEDQDVPDLTNFTVEELKQRYDSVINRLYTGIQCYSCGMRFTTSQTDVYADHLDWHYRQNRTEKDVSRKVTHRRWYYSLTDWIEFEEIADLEERAKSQFFEKVH

SEQ ID NO: 10106 - protein, 1555 aa, Homo Sapiens
MSEQTPAEAGAAGAREDACRDYQSSLEDLTFNSKPHINMLTILAEENLPFAKEIVSLIEAQTAKAPSSEKLPVMYLMDSIVKNVGREYLTAFTKNLVATFICVFEKVDENTRKSLFKLRSTWDEIFPLKKLYALDVRVNSLDPAWPIKPLPPNVNTSSIHVNPKFLNKSPEEPSTPGTVVSSPSISTPPIVPDIQKNLTQEQLIRQQLLAKQKQLLELQQKKLELELEQAKAQLAVSLSVQQETSNLGPGSAPSKLHVSQIPPMAVKAPHQVPVQSEKSRPGPSLQIQDLKGTNRDPRLNRISQHSHGKDQSHRKEFLMNTLNQSDTKTSKTIPSEKLNSSKQEKSKSGEKITKKELDQLDSKSKSKSKSPSPLKNKLSHTKDLKNQESESMRLSDMNKRDPRLKKHLQDKTDGKDDDVKEKRKTAEKKDKDEHMKSSEHRLAGSRNKIINGIVQKQDTITEESEKQGTKPGRSSTRKRSRSRSPKSRSPIIHSPKRRDRRSPKRRQRSMSPTSTPKAGKIRQSGAKQSHMEEFTPPSREDRNAKRSTKQDIRDPRRMKKTEEERPQETTNQHSTKSGTEPKENVENWQSSKSAKRWKSGWEENKSLQQVDEHSKPPHLRHRESWSSTKGILSPRAPKQQQHRLSVDANLQIPKELTLASKRELLQKTSERLASGEITQDDFLVVVHQIRQLFQYQEGVREEQRSPFNDRFPLKRPRYEDSDKPFVDSPASRFAGLDTNQRLTALAEDRPLFDGPSRPSVARDGPTKMIFEGPNKLSPRIDGPPTPASLRFDGSPGQMGGGGPLRFEGPQGQLGGGCPLRFEGPPGPVGTPLRFEGPIGQAGGGGFRFEGSPGLRFEGSPGGLRFEGPGGQPVGGLRFEGHRGQPVGGLRFEGPHGQPVGGLRFDNPRGQPVGGLRFEGGHGPSGAAIRFDGPHGQPGGGIRFEGPLLQQGVGMRFEGPHGQSVAGLRFEGQHNQLGGNLRFEGPHGQPGVGIRFEGPLVQQGGGMRFEGPSVPGGGLRIEGPLGQGGPRFEGCHALRFDGQPGQPSLLPRFDGLHGQPGPRFERTPGQPGPQRFDGPPGQQVQPRFDGVPQRFDGPQHQQASRFDIPLGLQGTRFDNHPSQRLESVSFNQTGPYNDPPGNAFNAPSQGLQFQRHEQIFDSPQGPNFNGPHGPGNQSFSNPLNRASGHYFDEKNLQSSQFGNFGNIPAPMTVGNIQASQQVLSGVAQPVAFGQGQQFLPVHPQNPGFVQNPSGALPKAYPDNHLSQVDVNELFSKLLKTGILKLSQTDSATTQVSEVTAQPPPEEEEDQNEDQDVPDLTNFTVEELKQRYDSVINRLYTGIQCYSCGMRFTTSQTDVYADHLDWHYRQNRTEKDVSRKVTHRRWYYSLTDWIEFEEIADLEERAKSQFFEKVHEEVVLKTQEAAKEKEFQSVPAGPAGAVESCEICQEQFEQYWDEEEEEWHLKNAIRVDGKIYHPSCYEDYQNTSSFDCTPSPSKTPVENPLNIMLNIVKNELQEPCDSPKVKEERIDTPPACTEESIATPSEIKTENDTVESV

SEQ ID NO: 10107 - protein, 999 aa, Homo Sapiens
MSEQTPAEAGAAGAREDACRDYQSSLEDLTFNSKPHINMLTILAEENLPFAKEIVSLIEAQTAKAPSSEKLPVMYLMDSIVKNVGREYLTAFTKNLVATFICVFEKVDENTRKSLFKLRSTWDEIFPLKKLYALDVRVNSLDPAWPIKPLPPNVNTSSIHVNPKFLNKSPEEPSTPGTVVSSPSISTPPIVPDIQKNLTQEQLIRQQLLAKQKQLLELQQKKLELELEQAKAQLAVSLSVQQETSNLGPGSAPSKLHVSQIPPMAVKAPHQVPVQSEKSRPGPSLQIQDLKGTNRDPRLNRISQHSHGKDQSHRKEFLMNTLNQSDTKTSKTIPSEKLNSSKQEKSKSGEKITKKELDQLDSKSKSKSKSPSPLKNKLSHTKDLKNQESESMRLSDMNKRDPRLKKHLQDKTDGKDDDVKEKRKTAEKKDKDEHMKSSEHRLAGSRNKIINGIVQKQDTITEESEKQGTKPGRSSTRKRSRSRSPKSRSPIIHSPKRRDRRSPKRRQRSMSPTSTPKAGKIRQSGAKQSHMEEFTPPSREDRNAKRSTKQDIRDPRRMKKTEEERPQETTNQHSTKSGTEPKENVENWQSSKSAKRWKSGWEENKSLQQVDEHSKPPHLRHRESWSSTKGILSPRAPKQQQHRLSVDANLQIPKELTLASKRELLQKTSERLASGEITQDDFLVVVHQIRQLFQYQEGKHRCNVRDSPTEENKGGLKKKPLLSDAELTYYEHKAKLKRTQVQHSFPRLDLLDPDIFDYPLTDALLSGIECEPSKSKHASRNSGAQFDRKEQFSERARRLSPISGSRTYAENLSPHEGRRRHDEQVSAKGVREEQRSPFNDRFPLKRPRYEDSDKPFVDSPASRFAGLDTNQRLTALAEDRPLFDGPSRPSVARDGPTKMIFEGPNKLSPRIDGPPTPASLRFDGSPGQMGGGGPLRFEGPQGQLGGGCPLRFEGPPGPVGTPLRFEGPIGQAGGGGFRFEGSPGLRFEGSPGGLRFEGP

SEQ ID NO: 10108 - protein, 784 aa, Homo Sapiens
MSEQTPAEAGAAGAREDACRDYQSSLEDLTFNSKPHINMLTILAEENLPFAKEIVSLIEAQTAKAPSSEKLPVMYLMDSIVKNVGREYLTAFTKNLVATFICVFEKVDENTRKSLFKLRSTWDEIFPLKKLYALDVRVNSLDPAWPIKPLPPNVNTSSIHVNPKFLNKSPEEPSTPGTVVSSPSISTPPIVPDIQKNLTQEQLIRQQLLAKQKQLLELQQKKLELELEQAKAQLAVSLSVQQETSNLGPGSAPSKLHVSQIPPMAVKAPHQVPVQSEKSRPGPSLQIQDLKGTNRDPRLNRISQHSHGKDQSHRKEFLMNTLNQSDTKTSKTIPSEKLNSSKQEKSKSGEKITKKELDQLDSKSKSKSKSPSPLKNKLSHTKDLKNQESESMRLSDMNKRDPRLKKHLQDKTDGKDDDVKEKRKTAEKKDKDEHMKSSEHRLAGSRNKIINGIVQKQDTITEESEKQGTKPGRSSTRKRSRSRSPKSRSPIIHSPKRRDRRSPKRRQRSMSPTSTPKAGKIRQSGAKQSHMEEFTPPSREDRNAKRSTKQDIRDPRRMKKTEEERPQETTNQHSTKSGTEPKENVENWQSSKSAKRWKSGWEENKSLQQVDEHSKPPHLRHRESWSSTKGILSPRAPKQQQHRLSVDANLQIPKELTLASKRELLQKTSERLASGEITQDDFLVVVHQIRQLFQYQEGVREEQRSPFNDRFPLKRPRYEDSDKPFVDSPASRFAGLDTNQRLTALAEDRPLFDGPSRPSVARDGPTKMIFEGPNKLSPRIDGPP

SEQ ID NO: 10109 - protein, 99 aa, Homo Sapiens
MSEQTPAEAGAAGAREDACRDYQSSLEDLTFNSKPHINMLTILAEENLPFAKEIVSLIEAQTAKVDENTRKSLFKLRSTWDEIFPLKKLYALDVRVNSL

SEQ ID NO: 10110 - protein, 449 aa, Homo Sapiens
MLPAATASLLGPLLTACALLPFAQGQTPNYTRPVFLCGGDVKGESGYVASEGFPNLYPPNKECIWTITVPEGQTVSLSFRVFDLELHPACRYDALEVFAGSGTSGQRLGRFCGTFRPAPLVAPGNQVTLRMTTDEGTGGRGFLLWYSGRATSGTEHQFCGGRLEKAQGTLTTPNWPESDYPPGISCSWHIIAPPDQVIALTFEKFDLEPDTYCRYDSVSVFNGAVSDDSRRLGKFCGDAVPGSISSEGNELLVQFVSDLSVTADGFSASYKTLPRGTAKEGQGPGPKRGTEPKVKLPPKSQPPEKTEESPSAPDAPTCPKQCRRTGTLQSNFCASSLVVTATVKSMVREPGEGLAVTVSLIGAYKTGGLDLPSPPTGASLKFYVPCKQCPPMKKGVSYLLMGQVEENRGPVLPPESFVVLHRPNQDQILTNLSKRKCPSQPVRAAASQD

SEQ ID NO: 10111 - protein, 303 aa, Homo Sapiens
MRGANAWAPLCLLLAAATQLSRQQSPERPVFTCGGILTGESGFIGSEGFPGVYPPNSKCTWKITVPEGKVVVLNFRFIDLESDNLCRYDFVDVYNGHANGQRIGRFCGTFRPGALVSSGNKMMVQMISDANTAGNGFMAMFSAAEPNERGDQYCGGLLDRPSGSFKTPNWPDRDYPAGVTCVWHIVAPKNQLIELKFEKFDVERDNYCRYDYVAVFNGGEVNDARRIGKYCGDSPPAISRHCYHNHHSRWEFARHSLDHQHLQRGKFGDSAGGQEHECQADCRLQAVPSPQKRSKLHYYGPSR

SEQ ID NO: 10112 - protein, 415 aa, Homo Sapiens
MRGANAWAPLCLLLAAATQLSRQQSPERPVFTCGGILTGESGFIGSEGFPGVYPPNSKCTWKITVPEGKVVVLNFRFIDLESDNLCRYDFVDVYNGHANGQRIGRFCGTFRPGALVSSGNKMMVQMISDANTAGNGFMAMFSAAEPNERGDQYCGGLLDRPSGSFKTPNWPDRDYPAGVTCVWHIVAPKNQLIELKFEKFDVERDNYCRYDYVAVFNGGEVNDARRIGKYCGDSPPAPIVSERNELLIQFLSDLSLTADGFIGHYIFRPKKLPTTTEQPVTTTFPVTTGLKPTVALCQQKCRRTGTLEGNYCSSDFVLAGTVITTITRDGSLHATVSIINIYKEGNLAIQQAGKNMSARLTVVCKQCPLLRRGLNYIIMGQVGEDGRGKIMPNSFIMMFKTKNQKLLDALKNKQC

SEQ ID NO: 10113 - protein, 140 aa, Homo Sapiens
TEQPVTTTFPVTTGLKPTVALCQQKCRRTGTLEGNYCSSDFVLAGTVITTITRDGSLHATVSIINIYKEGNLAIQQAGKNMSARLTVVCKQCPLLRRGLNYIIMGQVGEDGRGKIMPNSFIMMFKTKNQKLLDALKNKQC

SEQ ID NO: 10114 - protein, 101 aa, Homo Sapiens
  misc_feature (1)..(1): Xaa can be any naturally occurring amino acid
XGTFRPGALVSSGNKMMVQMISDANTAGNGFMAMFSAAEPNERGKKKKRGPESTSPLSRVAMLCQGISIVEDSLTDLPALLKPPTGQTGITLQESLVCGTL

SEQ ID NO: 10115 - protein, 158 aa, Homo Sapiens
MERRAWSLQCTAFVLFCAWCALNSAKAKRQFVNEWAAEIPGGPEAASAIAEELGYDLLGQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITG

SEQ ID NO: 10116 - protein, 753 aa, Homo Sapiens
MERRAWSLQCTAFVLFCAWCALNSAKAKRQFVNEWAAEIPGGPEAASAIAEELGYDLLGQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPEASYDFNDNDHDPFPRYDPTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEANPNLTWRDMQHLVVWTSEYDPLANNPGWKKNGAGLMVNSRFGFGLLNAKALVDLADPRTWRSVPEKKECVVKDNDFEPRALKANGEVIIEIPTRACEGQENAIKSLEHVQFEATIEYSRRGDLHVTLTSAAGTSTVLLAERERDTSPNGFKNWDFMSVHTWGENPIGTWTLRITDMSGRIQNEGRIVNWKLILHGTSSQPEHMKQPRVYTSYNTVQNDRRGVEKMVDPGEEQPTQENPKENTLVSKSPSSSSVGGRRDELEEGAPSQAMLRLLQSAFSKNSPPKQSPKKSPSAKLNIPYENFYEALEKLNKPSQLKDSEDSLYNDYVDVFYNTKPYKHRDDRLLQALVDILNEEN

SEQ ID NO: 10117 - protein, 706 aa, Homo Sapiens
MGKGSISFLFFSQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPEASYDFNDNDHDPFPRYDPTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEANPNLTWRDMQHLVVWTSEYDPLANNPGWKKNGAGLMVNSRFGFGLLNAKALVDLADPRTWRSVPEKKECVVKDNDFEPRALKANGEVIIEIPTRACEGQENAIKSLEHVQFEATIEYSRRGDLHVTLTSAAGTSTVLLAERERDTSPNGFKNWDFMSVHTWGENPIGTWTLRITDMSGRIQNEGRIVNWKLILHGTSSQPEHMKQPRVYTSYNTVQNDRRGVEKMVDPGEEQPTQENPKENTLVSKSPSSSSVGGRRDELEEGAPSQAMLRLLQSAFSKNSPPKQSPKKSPSAKLNIPYENFYEALEKLNKPSQLKDSEDSLYNDYVDVFYNTKPYKHRDDRLLQALVDILNEEN

SEQ ID NO: 10118 - protein, 260 aa, Homo Sapiens
MAGSPLLWGPRAGGVGLLVLLLLGLFRPPPALCARPVKEPRGLSAASPPLAETGAPRRFRRSVPRGEAAGAVQELARALAHLLEAERQERARAEAQEAEDQQARVLAQLLRVWGAPRNSDPALGLDDDPDAPAAQLARALLRARLDPAALAAQLVPAPVPAAALRPRPPVYDDGPAGPDAEEAGDETPDVDPELLRYLLGRILAGSADSEGVAAPRRLRRAADHDVGSELPPEGVLGALLRVKRLETPAPQVPARRLLPP

SEQ ID NO: 10119 - protein, 638 aa, Homo Sapiens
MKGGCVSQWKAAAGFLFCVMVFASAERPVFTNHFLVELHKGGEDKARQVAAEHGFGVRKLPFAEGLYHFYHNGLAKAKRRRSLHHKQQLERDPRVKMALQQEGFDRKKRGYRDINEIDINMNDPLFTKQWYLINTGQADGTPGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 10120 - protein, 603 aa, Homo Sapiens
MKGGCVSQWKAAAGFLFCVMVFASAERPVFTNHFLVELHKGGEDKARQVAAEHGFGVRKVKMALQQEGFDRKKRGYRDINEIDINMNDPLFTKQWYLINTGQADGTPGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 10121 - protein, 619 aa, Homo Sapiens
MVFASAERPVFTNHFLVELHKGGEDKARQVAAEHGFGVRKLPFAEGLYHFYHNGLAKAKRRRSLHHKQQLERDPRVKMALQQEGFDRKKRGYRDINEIDINMNDPLFTKQWYLINTGQADGTPGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 10122 - protein, 755 aa, Homo Sapiens
MRPAPIALWLRLVLALALVRPRAVGWAPVRAPIYVSSWAVQVSQGNREVERLARKFGFVNLGPIFPDGQYFHLRHRGVVQQSLTPHWGHRLHLKKNPKVQWFQQQTLQRRVKRSVVVPTDPWFSKQWYMNSEAQPDLSILQAWSQGLSGQGIVVSVLDDGIEKDHPDLWANYDPLASYDFNDYDPDPQPRYTPSKENRHGTRCAGEVAAMANNGFCGVGVAFNARIGGVRMLDGTITDVIEAQSLSLQPQHIHIYSASWGPEDDGRTVDGPGILTREAFRRGVTKGRGGLGTLFIWASGNGGLHYDNCNCDGYTNSIHTLSVGSTTQQGRVPWYSEACASTLTTTYSSGVATDPQIVTTDLHHGCTDQHTGTSASAPLAAGMIALALEANPFLTWRDMQHLVVRASKPAHLQAEDWRTNGVGRQVSHHYGYGLLDAGLLVDTARTWLPTQPQRKCAVRVQSRPTPILPLIYIRENVSACAGLHNSIRSLEHVQAQLTLSYSRRGDLEISLTSPMGTRSTLVAIRPLDVSTEGYNNWVFMSTHFWDENPQGVWTLGLENKGYYFNTGTLYRYTLLLYGTAEDMTARPTGPQVTSSACVQRDTEGLCQACDGPAYILGQLCLAYCPPRFFNHTRLVTAGPGHTAAPALRVCSSCHASCYTCRGGSPRDCTSCPPSSTLDQQQGSCMGPTTPDSRPRLRAAACPHHRCPASAMVLSLLAVTLGGPVLCGMSMDLPLYAWLSRARATPTKPQVWLPAGT

SEQ ID NO: 10123 - protein, 230 aa, Homo Sapiens
MRPAPIALWLRLVLALALVRPRAVGWAPVRAPIYVSSWAVQVSQGNREVERLARKFGFVNLGPIFPDGQYFHLRHRGVVQQSLTPHWGHRLHLKKNPKVQWFQQQTLQRRVKRSVVVPTDPWFSKQWYMNSEAQPDLSILQAWSQGLSGQGIVVSVLDDGIEKDHPDLWANYDPLASYDFNDYDPDPQPRYTPSKENRRTDAGRYHHRCHRGPVAEPAAAAHPHLQRQLG

SEQ ID NO: 10124 - protein, 318 aa, Homo Sapiens
  misc_feature (1)..(1): Xaa can be any naturally occurring amino acid
XPIALWLRLVLALALVRPRAVGWAPVRAPIYVSSWAVQVSQGNREVERLARKFGFVNLGPIFPDGQYFHLRHRGVVQQSLTPHWGHRLHLKKNPKVQWFQQQTLQRRVKRSVVVPTDPWFSKQWYMNSEAQPDLSILQAWSQGLSGQGIVVSVLDDGIEKDHPDLWANYDPLASYDFNDYDPDPQPRYTPSKENRRTDAGRYHHRCHRGPVAEPAAAAHPHLQRQLGSRGRRPHGGRPRHPHPRGLPAWCDQASTRFPWAAPPSRAACPGTAKPAPPPSPPPTAAAWPPTPRSSPRTCITGAQTSTRAPRPQPHWRPA

SEQ ID NO: 10125 - protein, 101 aa, Homo Sapiens
CQPCHRFCATCAGAGADGCINCTEGYFMEDGRCVQSCSISYYFDHSSENGYKSCKKCDISCLTCNGPGFKNCTSCPSGYLLDLGMCQMGAICKDVSLFRGA

SEQ ID NO: 10126 - protein, 690 aa, Homo Sapiens
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGELASSGTQAKKRQLMHHPTTWENRMEWNGMKWNGMKWNGMEWNGMEWNRIESNRIE

SEQ ID NO: 10127 - protein, 913 aa, Homo Sapiens
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDATEESWAEGGFCMLVKKNNLCQRKVLQQLCCKTCTFQG

SEQ ID NO: 10128 - protein, 1860 aa, Homo Sapiens
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDDPGTCTSCAMGYYRFDHHCYKTCPEKTYSEEVECKACDSNCGSCDQNGCYWCEEGFFLLGGSCVRKCGPGFYGDQEMGECESCHRACETCTGPGHDECSSCQEGLQLLRGMCVHATKTQEEGKFWNDILRKLQPCHSSCKTCNGSATLCTSCPKGAYLLAQACVSSCPQGTWPSVRSGSCENCTEACAICSGADLCKKCQMQPGHPLFLHEGRCYSKCPEGSYAEDGICERCSSPCRTCEGNATNCHSCEGGHVLHHGVCQENCPERHVAVKGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRDCHKSCLTCSSSGTCTTCQKGLIMNPRGSCMANEKCSPSEYWDEDAPGCKPCHVKCFHCMGPAEDQCQTCPMNSLLLNTTCVKDCPEGYYADEDSNRCAHCHSSCRTCEGRHSRQCHSCRPGWFQLGKECLLQCREGYYADNSTGRCERCNRSCKGCQGPRPTDCLSCDRFFFLLRSKGECHRSCPDHYYVEQSTQTCERCHPTCDQCKGKGALNCLSCVWSYHLMGGICTSDCLVGEYRVGEGEKFNCEKCHESCMECKGPGAKNCTLCPANLVLHMDDSHCLHCCNTSDPPSAQECCDCQDTTDECILRTSKVRPATEHFKTALFITSSMMLVLLLGAAVVVWKKSRGRVQPAAKAGYEKLADPNKSYSSYKSSYRESTSFEEDQVIEYRDRDYDEDDDDDIVYMGQDGTVYRKFKYGLLDDDDIDELEYDDESYSYYQ

SEQ ID NO: 10129 - protein, 1560 aa, Homo Sapiens
NSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDDPGTCTSCAMGYYRFDHHCYKTCPEKTYSEEVECKACDSNCGSCDQNGCYWCEEGFFLLGGSCVRKCGPGFYGDQEMGECESCHRACETCTGPGHDECSSCQEGLQLLRGMCVHATKTQEEGKFWNEAVSTANLSVVKSLLQERRRWKVQIKRDILRKLQPCHSSCKTCNGSATLCTSCPKGAYLLAQACVSSCPQGTWPSVRSGSCENCTEACAICSGADLCKKCQMQPGHPLFLHEGRCYSKCPEGSYAEDGICERCSSPCRTCEGNATNCHSCEGGHVLHHGVCQENCPERHVAVKGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRDCHKSCLTCSSSGTCTTCQKGLIMNPRGSCMANEKCSPSEYWDEDAPGCKPCHVKCFHCMGPAEDQCQTCPMNSLLLNTTCVKDCPEGYYADEDSNRCAHCHSSCRTCEGRHSRQCHSCRPGWFQLGKECLLQCREGYYADNSTGRCERCNRSCKGCQGPRPTDCLSCDRFFFLLRSKGECHRSCPDHYYVEQSTQTCERCHPTCDQCKGKGALNCLSCVWSYHLMGGICTSDCLVGEYRVGEGEKFNCEKCHESCMECKGPGAKNCTLCPANLVLHMDDSHCLHCCNTSDPPSAQECCDCQDTTDECILRTSKVRPATEHFKTALFITSSMMLVLLLGAAVVVWKKSRGRVQPAAKAGYEKLADPNKSYSSYKSSYRESTSFEEDQVIEYRDRDYDEDDDDDIVYMGQDGTVYRKFKYGLLDDDDIDELEYDDESYSYYQ

SEQ ID NO: 10130 - protein, 692 aa, Homo Sapiens
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 10131 - protein, 293 aa, Homo Sapiens
MGRVVAELVSSLLGLWLLLCSCGCPEGAELRAPPDKIAIIGAGIGGTSAAYYLRQKFGKDVKIDLFEREEVGGRLATMMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDINAFVGAVSLSCSDSGLWAVEGGNKLVCSGLLQASKSNLISGSVMYIEEKTKTKYTVLGLCPL

SEQ ID NO: 10132 - protein, 505 aa, Homo Sapiens
MGRVVAELVSSLLGLWLLLCSCGCPEGAELRAPPDKIAIIGAGIGGTSAAYYLRQKFGKDVKIDLFEREEVGGRLATMMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDINAFVGAVSLSCSDSGLWAVEGGNKLVCSGLLQASKSNLISGSVMYIEEKTKTKYTGNPTKMYEVVYQIGTETRSDFYDIVLVATPLNRKMSNITFLNFDPPIEEFHQYYQHIVTTLVKGELNTSIFSSRPIDKFGLNTVLTTDNSDLFINSIGIVPSVREKEDPEPSTDGTYVWKIFSQETLTKAQILKLFLSYDYAVKKPWLAYPHYKPPEKCPSIILHDRLYYLNGIECAASAMEMSAIAAHNAALLAYHRWNGHTDMIDQDGLYEKLKTEL

SEQ ID NO: 10133 - protein, 130 aa, Homo Sapiens
MMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAG

SEQ ID NO: 10134 - protein, 154 aa, Homo Sapiens
MMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDI

SEQ ID NO: 10135 - protein, 209 aa, Homo Sapiens
MMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDINAFVGAVSLSCSDSGLWAVEGGNKLVCSGLLQASKSNLISGSVMYIEEKTKTKYT

SEQ ID NO: 10136 - protein, 111 aa, Homo Sapiens
MARAAPLLAALTALLAAAAAGGDAPPGKIAVVGAGIGGSAVAHFLQQHFGPRVQIDVYEKGTVGGRLATISVNKQHYESGAASFHSLSLHMQDFVKLLDGATETREGKELA

SEQ ID NO: 10137 - protein, 494 aa, Homo Sapiens
MARAAPLLAALTALLAAAAAGGDAPPGKIAVVGAGIGGSAVAHFLQQHFGPRVQIDVYEKGTVGGRLATISVNKQHYESGAASFHSLSLHMQDFVKLLGLRHRREVVGRSAIFGGEHFMLEETDWYLLNLFRLWWHYGISFLRLQMWVEEVMEKFMRIYKYQAHGYAFSGVEELLYSLGESTFVNMTQHSVAESLLQVGVTQRFIDDVVSAVLRASYGQSAAMPAFAGAMSLAGAQGSLWSVEGGNKLVCSGLLKLTKANVIHATVTSVTLHSTEGKALYQVAYENEVGNSSDFYDIVVIATPLHLDNSSSNLTFAGFHPPIDDVQGSFQPTVVSLVHGYLNSSYFGFPDPKLFPFANILTTDFPSFFCTLDNICPVNISASFRRKQPQEAAVWRVQSPKPLFRTQLKTLFRSYYSVQTAEWQAHPLYGSRPTLPRFALHDQLFYLNALEWAASSVEVMAVAAKNVALLAYNRWYQDLDKIDQKDLMHKVKTEL

SEQ ID NO: 10138 - protein, 82 aa, Homo Sapiens
MARAAPLLAALTALLAAAAAGGDAPPGKIGAGRTRGGWGWDWGLCCGPFSPAALWTSGADRRVREGNRGWPLGHHLSQQAAL

SEQ ID NO: 10139 - protein, 82 aa, Homo Sapiens; identical to SEQ ID NO: 10138

SEQ ID NO: 10140 - protein, 404 aa, Homo Sapiens
MQDFVKLLGLRHRREVVGRSAIFGGEHFMLEETDWYLLNLFRLWWHYGISFLRLQMWVEEVMEKFMRIYKYQAHGYAFSGVEELLYSLGESTFVNMTQHSVAESLLQVGVTQRFIDDVVSAVLRASYGQSAAMPAFAGAMSLAGAQGSLWSVEGGNKLVCSGLLKLTKANVIHATVTSVTLHSTEGKALYQVAYENEVGNSSDFYDIVVIATPLHLDNSSSNLTFAGFHPPIDDVQGSFQPTVVSLVHGYLNSSYFGFPDPKLFPFANILTTDFPSFFCTLDNICPVNISASFRRKQPQEAAVWRVQSPKPLFRTQLKTLFRSYYSVQTAEWQAHPLYGSRPTLPRFALHDQLFYLNALEWAASSVEVMAVAAKNVALLAYNRWYQDLDKIDQKDLMHKVKTEL

SEQ ID NO: 10141 - protein, 933 aa, Homo Sapiens
MAASRLDFGEVETFLDRHPELFEDYLMRKGKQEMVEKWLQRHSQGQGALGPRPSLAGTSSLAHSTCRGGSSVGGGTGPNGSAHSQPLPGGGDCGGVPLSPSWAGGSRGDGNLQRRASQKELRKSFARSKAIHVNRTYDEQVTSRAQEPLSSVRRRALLRKASSLPPTTAHILSALLESRVNLPRYPPTAIDYKCHLKKHNERQFFLELVKDISNDLDLTSLSYKILIFVCLMVDADRCSLFLVEGAAAGKKTLVSKFFDVHAGTPLLPCSSTENSNEVQVPWGKGIIGYVGEHGETVNIPDAYQDRRFNDEIDKLTGYKTKSLLCMPIRSSDGEIIGVAQAINKIPEGAPFTEDDEKVMQMYLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 10142 - protein, 575 aa, Homo Sapiens
MQMYLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 10143 - protein, 36 aa, Homo Sapiens
MQMYLPFCGIAISNAQLFAASRKEYERSRSYVRDVY

SEQ ID NO: 10144 - protein, 489 aa, Homo Sapiens
MSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 10145 - protein, 437 aa, Homo Sapiens
  misc_feature (1)..(1): Xaa can be any naturally occurring amino acid
XLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQ

SEQ ID NO: 10146 - protein, 136 aa, Homo Sapiens
  misc_feature (1)..(1): Xaa can be any naturally occurring amino acid
XVLPLVEERKISMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 10147 - protein, 327 aa, Homo Sapiens
FPTASSVPEHKGVGFHAWDVRNLRKLRGQVPAGSLPPTDPSLHRWFLAPLPSPEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEG

SEQ ID NO: 10148 - protein, 38 aa, Homo Sapiens
MGQACGHSILCRSQQYPAARPAEPQPGPPCKGARTPRE

SEQ ID NO: 10149 - protein, 941 aa, Homo Sapiens
MGQACGHSILCRSQQYPAARPAEPRGQQVFLKPDEPPPPPQPCADSLQDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 10150 - protein, 826 aa, Homo Sapiens
MGQACGHSILCRSQQYPAARPAEPRGQQVFLKPDEPPPPPQPCADSLQVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 10151 - protein, 39 aa, Homo Sapiens
MGQACGHSILCRSQQYPAARPAEPSLQLPEHCFHTCDLI

SEQ ID NO: 10152 - protein, 932 aa, Homo Sapiens
MKKQRIQEGKSLAHRRGQQVFLKPDEPPPPPQPCADSLQDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 10153 - protein, 198 aa, Homo Sapiens
MLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTT

SEQ ID NO: 10154 - protein, 178 aa, Homo Sapiens
MMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFD

SEQ ID NO: 10155 - protein, 87 aa, Homo Sapiens
MRRQPAASLDPLAKEPGPPGSRDDRLEDALLSLGSVIDISGLQRAVKEALSAVLPRVETVYTYLLDGESQLVCEDPPHELPQEGKVR

SEQ ID NO: 10156 - protein, 144 aa, Homo Sapiens
MRRQPAASLDPLAKEPGPPGSRDDRLEDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVH

SEQ ID NO: 10157 - protein, 920 aa, Homo Sapiens
MRRQPAASLDPLAKEPGPPGSRDDRLEDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 10158 - protein, 92 aa, Homo Sapiens
MSYILKMPGTCLPGEGTTYELPPSSLHPSSAPVTSGGTCPALLTEAGWEAPIMAFTEAASAVGPSWTHSGASRSSSSRTSRRRRRSHAPTAC

SEQ ID NO: 10159 - protein, 106 aa, Homo Sapiens
MVLVLHHILIAVVQFLRRGQQVFLKPDEPPPPPQPCADSLQDALLSLGSVIDISGLQRAVKEALSAVLPRVETVYTYLLDGESQLVCEDPPHELPQEGKVRCTVAS

SEQ ID NO: 10160 - protein, 934 aa, Homo Sapiens
MVLVLHHILIAVVQFLRRGQQVFLKPDEPPPPPQPCADSLQDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 10161 - protein, 685 aa, Homo Sapiens
MVLVLHHILIAVVQFLRRGQQVFLKPDEPPPPPQPCADSLQDALLSLGSVIDISGLQRAVKEALSAVLPRVETVYTYLLDGESQLVCEDPPHELPQEGKVRFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 10162 - protein, 92 aa, Homo Sapiens
MVLVLHHILIAVVQFLRRGQQVFLKPDEPPPPPQPCADSLQETVYTYLLDGRLSSPRSGWAAMGWASQTCQGSPWPGWWLHWLLIPKCWSCR

SEQ ID NO: 10163 - protein, 65 aa, Homo Sapiens
MVLVLHHILIAVVQFLRRGQQVFLKPDEPPPPPQPCADSLQPAWTPLQRSQDPQGVETTDWRTPC

SEQ ID NO: 10164 - protein, 65 aa, Homo Sapiens; identical to SEQ ID NO: 10163

SEQ ID NO: 10165 - protein, 65 aa, Homo Sapiens; identical to SEQ ID NO: 10163

SEQ ID NO: 10166 - protein, 336 aa, Homo Sapiens
PGLDRSRGRGRAELGGEVGGLGDPGSRRRARRGAERRLRDPDTEVRRGPLSDRRLALAGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQ

SEQ ID NO: 10167 - protein, 75 aa, Homo Sapiens
  misc_feature (1)..(1): Xaa can be any naturally occurring amino acid
XLWLVASGGRHSAFPVSHPKGVGLACLPSTVASTGGCHWETGRAWEFRELRPAWTPLQRSQDPQGVETTDWRTPC

SEQ ID NO: 10168 - protein, 172 aa, Homo Sapiens
  misc_feature (1)..(1): Xaa can be any naturally occurring amino acid
XSAVTPSPCLSLSQLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDV

SEQ ID NO: 10169 - protein, 482 aa, Homo Sapiens
MEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 10170 - protein, 424 aa, Homo Sapiens
MEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGNYTYLDIAG

SEQ ID NO: 10171 - protein, 86 aa, Homo Sapiens
MGITLIWCLALVLIKWITSKRRGAISYDSSDQTALYIRMLGDVRVRSRAGFESERRGSHPYIDFRIFHSQSEIEVSVSARNIRRLL

SEQ ID NO: 10172 - protein, 456 aa, Homo Sapiens
MGITLIWCLALVLIKWITSKRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 10173 - protein, 243 aa, Homo Sapiens
MARLWGALSLWPLWAAVPWGGAAAVGVRACSSTAAPDGVEGPALRRSYWRHLRRLVLGPPEPPFSHVCQVGDPVLRGVAAPVERAQLGGPELQRLTQRLVQVMRRRRCVGLSAPQLGVPRQVLALELPEALCRECPPRQRALRQMEPFPLRVFVNPSLRVLDSRLVTFPEGCESVAGFLACVPRFQAVQISGLDPNGEQVVWQASGWAARIIQHEMDHLQGCLFIDKMDSRTFTNVYWMKVND

SEQ ID NO: 10174 - protein, 86 aa, Homo Sapiens
MRTLACLLLLGCGYLAHVLAEEAEIPREVIERLARSQIHSIRDLQRLLEIDSVGSEDSLDTSLRAHGVHATKHVPEKRPLPIRRKR

SEQ ID NO: 10175 - protein, 196 aa, Homo Sapiens
MRTLACLLLLGCGYLAHVLAEEAEIPREVIERLARSQIHSIRDLQRLLEIDSVGSEDSLDTSLRAHGVHATKHVPEKRPLPIRRKRSIEEAVPAVCKTRTVIYEIPRSQVDPTSANFLIWPPCVEVKRCTGCCNTSSVKCQPSRVHHRSVKVAKVEYVRKKPKLKEVQVRLEEHLECACATTSLNPDYREEDTDVR

SEQ ID NO: 10176 - protein, 211 aa, Homo Sapiens [sequence omitted]

SEQ ID NO: 10177 - protein, 205 aa, Homo Sapiens
QRQAAALGSQSPSPAGLRAGAVPPARACLQEAEIPREVIERLARSQIHSIRDLQRLLEIDSVGSEDSLDTSLRAHGVHATKHVPEKRPLPIRRKRSIEEAVPAVCKTRTVIYEIPRSQVDPTSANFLIWPPCVEVKRCTGCCNTSSVKCQPSRVHHRSVKVAKVEYVRKKPKLKEVQVRLEEHLECACATTSLNPDYREEDTDVR

SEQ ID NO: 10178 - protein, 226 aa, Homo Sapiens
MFIMGLGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 10179 - protein, 136 aa, Homo Sapiens
MLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKK

SEQ ID NO: 10180 - protein, 144 aa, Homo Sapiens
MLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDH

SEQ ID NO: 10181 - protein, 241 aa, Homo Sapiens
MNRCWALFLSLCCYLRLVSAEGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 10182 - protein, 50 aa, Homo Sapiens
MSLFGLLLLTSALAGQRQGTQAESNLSSKFQFSSNKEQNGRNYIQASGLA

SEQ ID NO: 10183 - protein, 282 aa, Homo Sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVLQLRPKTGVRGLHKSLTDVALEHHEECDCVCRGSTGG

SEQ ID NO: 10184 - protein, 345 aa, Homo Sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 10185 - protein, 53 aa, Homo Sapiens
  misc_feature (1)..(1): Xaa can be any naturally occurring amino acid
XTFDERFGLEDPEDDICKYDFVEVEEPSDGTILGRWCGSGFCIHYNIVMPNLP

SEQ ID NO: 10186 - protein, 206 aa, Homo Sapiens
IFEAVGAQGTVVLDEESLHVDDLDLFDGDSGLRFAEDLEVSELKVGADLEREGDLGEVPPHAVHESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNW

SEQ ID NO: 10187 - protein, 364 aa, Homo Sapiens
MHRLIFVYTLICANFCSCRDTSATPQSASIKALRNANLRRDDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 10188 - protein, 370 aa, Homo Sapiens
MHRLIFVYTLICANFCSCRDTSATPQSASIKALRNANLRRDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 10189 - protein, 154 aa, Homo Sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTD

SEQ ID NO: 10190 - protein, 158 aa, Homo Sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETP

SEQ ID NO: 10191 - protein, 159 aa, Homo Sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPV

SEQ ID NO: 10192 - protein, 1089 aa, Homo Sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLDSEVKNLLSDDNSEGLTLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGTPYPGMMVDSTFYNKIKSGYRMAKPDHATSEVYEIMVKCWNSEPEKRPSFYHLSEIVENLLPGQYKKSYEKIHLDFLKSDHPAVARMRVDSDNAYIGVTYKNEEDKLKDWEGGLDEQRLSADSGYIIPLPDIDPVPEEEDLGKRNRHSSQTSEESAIETGSSSSTFIKREDETIEDIDMMDDIGIDSSDLVEDSFL

SEQ ID NO: 10193 - protein, 743 aa, Homo Sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSSGQGCLSSGTLQELSVDLQARGPC

SEQ ID NO: 10194 - protein, 218 aa, Homo Sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKGTCIISFLL

SEQ ID NO: 10195 - protein, 147 aa, Homo Sapiens
MLPRLVLNSWAQMICLPQLPKFPRAMGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVP

SEQ ID NO: 10196 - protein, 174 aa, Homo Sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYD

SEQ ID NO: 10197 - protein, 239 aa, Homo Sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQGEPPFWPDAQQSVIHQRLCERSADCGPPG

SEQ ID NO: 10198 - protein, 1106 aa, Homo Sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 10199 - protein, 146 aa, Homo Sapiens
MSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQ

SEQ ID NO: 10200 - protein, 375 aa, Homo Sapiens
MKVWLLLGLLLVHEALEDVTGQHLPKNKRPKEPGENRIKPTNKKVKPKIPKMKDRDSANSAPKTQSIMMQVLDKGRFQKPAATLSLLAGQTVELRCKGSRIGWSYPAYLDTFKDSRLSVKQNERYGQLTLVNSTSADTGEFSCWVQLCSGYICRKDEAKTGSTYIFFTEKGELFVPSPSYFDVVYLNPDRQAVVPCRVTVLSAKVTLHREFPAKEIPANGTDIVYDMKRGFVYLQPHSEHQGVVYCRAEAGGRSQISVKYQLLYVAVPSGPPSTTILASSNKVKSGDDISVLCTVLGEPDVEVEFTWIFPGQKDERPVTIQDTWRLIHRGLGHTTRISQSVITVEDFETIDAGYYICTAQNLQGQTTVATTVEFS

SEQ ID NO: 10201 - protein, 375 aa, Homo Sapiens; identical to SEQ ID NO: 10200

SEQ ID NO: 10202 - protein, 109 aa, Homo Sapiens
MELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 10203 - protein, 359 aa, Homo Sapiens
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 10204 - protein, 390 aa, Homo Sapiens
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 10205 - protein, 180 aa, Homo Sapiens
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVVKDEDCVLL

SEQ ID NO: 10206 - protein, 204 aa, Homo Sapiens
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQFLLPLTQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDG

SEQ ID NO: 10207 - protein, 397 aa, Homo Sapiens
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQFLLPLTQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 10208 - protein, 121 aa, Homo Sapiens
MRKMLAAVSRVLSGASQKPFAGSPPPRHLTVGRKLSSRYEVTFESAQASRVLVASRNFANDATFEIKKCDLHRLEEGPPVTTVLTREDGLKYYRMMQTVRRMELKADQLYKQKIIRGFCHL

SEQ ID NO: 10209 - protein, 205 aa, Homo Sapiens
MRKMLAAVSRVLSGASQKPRHGLATLPSLVSISRLKQSSHLGLPKCWDYSHSLKTRQASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIV

SEQ ID NO: 10210 - protein, 428 aa, Homo Sapiens
MRKMLAAVSRVLSGASQKPRHGLATLPSLVSISRLKQSSHLGLPKCWDYSHSLKTRQASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 10211 - protein, 154 aa, Homo Sapiens
AVLNGQVKEIPPDWDQRPVKTLVGKNFEQVAFDETKNVFVKFYAPWCTHCKEMAPAWEALAEKYQDHEDIIIAELDATANELDAFAVHGFPTLKYFPAGPGRKVIEYKSTRDLETFSKFLDNGGVLPTEEPPEEPAAPFPEPPANSTMGSKEEL

SEQ ID NO: 10212 - protein, 522 aa, Homo Sapiens
MSRQLLPVLLLLLLRASCPWGQEQGARSPSEEPPEEEIPKEDGILVLSRHTLGLALREHPALLVEFYAPWCGHCQALAPEYSKAAAVLAAESMVVTLAKVDGPAQRELAEEFGVTEYPTLKFFRNGNRTHPEEYTGPRDAEGIAEWLRRRVGPSAMRLEDEAAAQALIGGRDLVVIGFFQDEDVATFLALAQDALDMTFGLTDRPRLFQQFGLTKDTVVLFKKFDEGRADFPVDEELGLDLGDLSRFLVTHSMRLVTEFNSQTSAKIFAARILNHLLLFVNQTLAAHRELLAGFGEAAPRFRGQVLFVVVDVAADNEHVLQYFGLKAEAAPTLRLVNLETTKKYAPVDGGPVTAASITAFCHAVLNGQVKPYLLSQEIPPDWDQRPVKTLVGKNFEQVAFDETKNVFVKFYAPWCTHCKEMAPAWEALAEKYQDHEDIIIAELDATANELDAFAVHGFPTLKYFPAGPGRKVIEYKSTRDLETFSKFLDNGGVLPTEEPPEEPAAPFPEPPANSTMGSKEEL

SEQ ID NO: 10213 - protein, 525 aa, Homo Sapiens
MSRQLLPVLLLLLLRASCPWGQEQGARSPSEEPPEEEIPKEDGILVLSRHTLGLALREHPALLVEFYAPWCGHCQALAPEYSKAAAVLAAESMVVTLAKVDGPAQRELAEEFGVTEYPTLKFFRNGNRTHPEEYTGPRDAEGIAEWLRRRVGPSAMRLEDEAAAQALIGGRDLVVIGFFQDLQDEDVATFLALAQDALDMTFGLTDRPRLFQQFGLTKDTVVLFKKFDEGRADFPVDEELGLDLGDLSRFLVTHSMRLVTEFNSQTSAKIFAARILNHLLLFVNQTLAAHRELLAGFGEAAPRFRGQVLFVVVDVAADNEHVLQYFGLKAEAAPTLRLVNLETTKKYAPVDGGPVTAASITAFCHAVLNGQVKPYLLSQEIPPDWDQRPVKTLVGKNFEQVAFDETKNVFVKFYAPWCTHCKEMAPAWEALAEKYQDHEDIIIAELDATANELDAFAVHGFPTLKYFPAGPGRKVIEYKSTRDLETFSKFLDNGGVLPTEEPPEEPAAPFPEPPANSTMGSKEEL

SEQ ID NO: 10214 - protein, 227 aa, Homo Sapiens
  misc_feature (1)..(1): Xaa can be any naturally occurring amino acid
XLLPVLLLLLLRASCPWGQEQGARSPSEEPPEEEIPKEDGILVLSRHTLGLALREHPALLVEFYAPWCGHCQALAPEYSKAAAVLAAESMVVTLAKVDGPAQRELAEEFGVTEYPTLKFFRNGNRTHPEEYTGPRDAEGIAEWLRRRVGPSAMRLEDEAAAQALIGGRDLVVIGFFQDALDMTFGLTDRPRLFQQFGLTKDTVVLFKKFDEGRADFPVDEELGLDLG

SEQ ID NO: 10215 - protein, 71 aa, Homo Sapiens
MRLRRLALFPGVALLLAAARLAAASDVLELTDDNFESRISDTGSAGLMLVEFFAPCSIPAGFEEESLLQPH

SEQ ID NO: 10216 - protein, 505 aa, Homo Sapiens
MRLRRLALFPGVALLLAAARLAAASDVLELTDDNFESRISDTGSAGLMLVEFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 10217 - protein, 75 aa, Homo Sapiens
MRLRRLALFPGVALLLAAARLAAASDVLELTDDNFESRISDTGSAGLMLVEFFAPWLQNSPSQRDPSATLWLLKR

SEQ ID NO: 10218 - protein, 123 aa, Homo Sapiens
SDVLELTDDNFESRISDTGSAGLMLVEFFAPWCGHCKRLAPEYEAAATRLKGIVPLAKVDCTANTNTCNKYGVSGYPTLKIFRDGEEAGAYDGPRTAGVSSYFVLHISLTSLRTRLWHIQSKK

SEQ ID NO: 10219 - protein, 163 aa, Homo Sapiens
MRPRKAFLLLLLLGLVQLLAVAGAEGPDEDFRQVQANSRRTRPGSGKGEGEPLERRGEGVKKQVRVLWNSKHSFSKCDSSNRENAIEDEEEEEEEDDDEEEDDLEVKEENGVLVLNDANFDNFVADKDTVLLEFYAPWCGHCKQFAPEYEKIANILKDKDPPI

SEQ ID NO: 10220 - protein, 645 aa, Homo Sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 10221 - protein, 519 aa, Homo Sapiens
MARAGPAWLLLAIWVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQDGAFHTEYNRAVTFKSIVAFLKDPKGPPLWEEDPGAKDVVHLDSEKDFRRLLKKEEKPLLIMFYAPWCSMCKRMMPHFQKAATQLRGHAVLAGMNVYSSEFENIKEEYSVRGFPTICYFEKGRFLFQYDNYGSTAEDIVEWLKNPQPPQPQVPETPWADEGGSVYHLTDEDFDQFVKEHSSVLVMFHAPWCGHCKKMKPEFEKAAEALHGEADSSGVLAAVDATVNKALAERFHISEFPTLKYFKNGEKYAVPVLRTKKKFLEWMQNPEAPPPPEPTWEEQQTSVLHLVGDNFRETLKKKKHTLVMFYAPWCPHCKKVIPHFTATADAFKDDRKIACAAVDCVKDKNQDLCQQEAVKGYPTFHYYHYGKFAEKYDSDRTELGFTNYIRALREGDHERLGKKKEEL

SEQ ID NO: 10222 - protein, 262 aa, Homo Sapiens
MARAGPAWLLLAIWVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQDGAFHTEYNRAVTFKSIVAFLKDPKGPPLWEEDPGAKDVVHLDSEKDFRRLLKKEEKPLLIMFYAPWCSMCKRMMPHFQKAATQLRGHAVLAGMNVYSSEFENIKEEYSVRGFPTICYFEKGRFLFQYDNYGSTAEDIVEWLKKVWPL

SEQ ID NO: 10223 - protein, 64 aa, Homo Sapiens
MKVDLSPKDKKVELFHYQDGAFHTEYNRAVTFKSIVAFLKDPKGPPLWEEDPGAKDVVHLDSEK

SEQ ID NO: 10224 - protein, 83 aa, Homo Sapiens
  misc_feature (1)..(1): Xaa can be any naturally occurring amino acid
XTLVMFYAPWCPHCKKVIPHFTATADAFKDDRKIACAAVDCVKDKNQDLCQQEAVKGYPTFHYYHYGKFAEKYDSDRTVFSVG

SEQ ID NO: 10225 - protein, 440 aa, Homo Sapiens
MALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 10226 - protein, 437 aa, Homo Sapiens
MILGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 10227 - protein, 488 aa, Homo Sapiens
MRIITAPASKVSRGSNELMILARRSDRGSPTSPAHSLSRKSPIMYPSTTMANAPGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 10228 - protein, 492 aa, Homo Sapiens
MRRDLREKLVWVCRPLAPVEVPANISSDFQPCSPTSPAHSLSRKSPIMYPSTTMANAPGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 10229 - protein, 492 aa, Homo Sapiens; identical to SEQ ID NO: 10228

SEQ ID NO: 10230 - protein, 11 aa, Homo Sapiens
MYPSTTMANAP

SEQ ID NO: 10231 - protein, 445 aa, Homo Sapiens
MYPSTTMANAPGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 10232 - protein, 177 aa, Homo Sapiens
MDLLWMPLLLVAACVSAVHSSPEVNAGVSSIHITKPVHILEERSLLVLTPAGLTQMLNQTRFLMVLFHEVLLLLPRLKYNGAILAHRNLHLPGSSDSPASASQVAGITDNPSSKQSRNLAEELGKAVEIMGKGKNGIGFGKVDITIEKELQQEFGITKAPELKLFFEGNRSEPISCK

SEQ ID NO: 10233 - protein, 584 aa, Homo Sapiens
MDLLWMPLLLVAACVSAVHSSPEVNAGVSSIHITKPVHILEERSLLVLTPAGLTQMLNQTRFLMVLFHNPSSKQSRNLAEELGKAVEIMGKGKNGIGFGKVDITIEKELQQEFGITKAPELKLFFEGNRSEPISCKGVVESAALVVWLRRQISQKAFLFNSSEQVAEFVISRPLVIVGFFQDLEEEVAELFYDVIKDFPELTFGVITIGNVIGRFHVTLDSVLVFKKGKIVNRQKLINDSTNKQELNRVIKQHLTDFVIEYNTENKDLISELHIMSHMLLFVSKSSESYGIIIQHYKLASKEFQNKILFILVDADEPRNGRVFKYFRVTEVDIPSVQILNLSSDARYKMPSDDITYESLKKFGRSFLSKNATKHQSSEEIPKYWDQGLVKQLVGKNFNVVVFDKEKDVFVMFYAPWSKKCKMLFPLLEELGRKYQNHSTIIIAKIDVTANDIQLMYLDRYPFFRLFPSGSQQAVLYKGEHTLKGFSDFLESHIKTKIEDEDELLSVEQNEVIEEEVLAEEKEVPMMRKGLPEQQSPELENMTKYVSKLEEPAGKKKTSEEVVVVVAKPKGPPVQKKKPKVKEEL

SEQ ID NO: 10234 - protein, 254 aa, Homo Sapiens [sequence omitted]

SEQ ID NO: 10235 - protein, 254 aa, Homo Sapiens [sequence omitted]

SEQ ID NO: 10236 - protein, 254 aa, Homo Sapiens [sequence omitted]

SEQ ID NO: 10237 - protein, 1154 aa, Homo Sapiens
MGLLLMILASAVLGSFLTLLAQFFLLYRRQPEPPADEAARAGEGFRYIKPVPGLLLREYLYGGGRDEEPSGAAPEGGATPTAAPETPAPPTRETCYFLNATILFLFRELRDTALTRRWVTKKIKVEFEELLQTKTAGRLLEGLSLRDVFLGETVPFIKTIRLVRPVVPSATGEPDGPEGEALPAACPEELAFEAEVEYNGGFHLAIDVDLVFGKSAYLFVKLSRVVGRLRLVFTRVPFTHWFFSFVEDPLIDFEVRSQFEGRPMPQLTSIIVNQLKKIIKRKHTLPNYKIRFKPFFPYQTLQGFEEDEEHIHIQQWALTEGRLKVTLLECSRLLIFGSYDREANVHCTLELSSSVWEEKQRSSIKTVELIKGNLQSVGLTLRLVQSTDGYAGHVIIETVAPNSPAAIADLQRGDRLIAIGGVKITSTLQVLKLIKQAGDRVLVYYERPVGQSNQGAVLQDNFGQLEENFLSSSCQSGYEEEAAGLTVDTESRELDSEFEDLASDVRAQNEFKDEAQSLSHSPKRVPTTLSIKPLGAISPVLNRKLAVGSHPLPPKIQSKDGNKPPPLKTSEITDPAQVSKPTQGSAFKPPVPPRPQAKVPLPSADAPNQAEPDVLVEKPEKVVPPPLVDKSAEKQAKNVDAIDDAAAPKQFLAKQEVAKDVTSETSCPTKDSSDDRQTWESSEILYRNKLGKWTRTRASCLFDIEACHRYLNIALWCRDPFKLGGLICLGHVSLKLEDVALGCLATSNTEYLSKLRLEAPSPKAIVTRTALRNLSMQKGFNDKFCYGDITIHFKYLKEGESDHHVVTNVEKEKEPHLVEEVSVLPKEEQFVGQMGLTENKHSFQDTQFQNPTWCDYCKKKVWTKAASQCMFCAYVCHKKCQEKCLAETSVCGATDRRIDRTLKNLRLEGQETLLGLPPRVDAEASKSVNKTTGLTRHIINTSSRLLNLRQVSKTRLSEPGTDLVEPSPKHTPNTSDNEGSDTEVCGPNSPSKRGNSTGIKLVRKEGGLDDSVFIAVKEIGRDLYRGLPTEERIQKLEFMLDKLQNEIDQELEHNNSLVREEKETTDTRKKSLLSAALAKSGERLQALTLLMIHYRAGIEDIETLESLSLDQHSKKISKYTDDTEEDLDNEISQLIDSQPFSSISDDLFGPSESV

SEQ ID NO: 10238 - protein, 778 aa, Homo Sapiens
MGCNLCTFQKREEHYKLLYEVSQVNGKDLSKATHEEAVEAFRNAKEPIVVQVLRRTPLSRPAYGMASEVQLMNASTQTDITFEHIMALAKLRPPTPPVPDICPFLLSDSCHSLHPMEHEFYEDNEYISSLPADADRTEDFEYEEVELCRVSSQEKLGLTVCYRTDDEEDTGIYVSEVDPNSIAAKDGRIREGDRILQINGEDVQNREEAVALLSNDECKRIVLLVARPEIQLDEGWLEDERNEFLEELNLEMLEEEHNEAMQPTANEVEQPKKQEEEEGTTDTATSSSNNHEKDSGVGRTDESLRNDESSEQENAAEDPNSTSLKSKRDLGQSQDTLGSVELQYNESLVSGEYIDSDCIGNPDEDCERFRQLLELKCKIRNHGEYDLYYSSSTIECNQGEQEGVEHELQLLNEELRNIELECQNIMQAHRLQKVTDQYGDIWTLHDGGFRNYNTSIDMQRGKLDDIMEHPEKSDKDSSSAYNTAESCRSTPLTVDRSPDSSLPRVINLTNKKNLRSTMAATQSSSGQSSKESTSTKAKTTEQGCSAESKEKVLEGSKLPDQEKAVSEHIPYLSPYHSSSYRYANIPAHARHYQSYMQLIQQKSAVEYAQSQLSLVSMCKESQKCSEPKMEWKVKIRSDGTRYITKRPVRDRILKERALKIKEERSGMTTDDDTMSEMKMGRYWSKEERKQHLVRAKEQRRRREFMMRSRLECLKESPQSGSEGKKEINIIELSHKKMMKKRNKKILDNWMTIQELMTHGAKSPDGTRVHNAFLSVTTV

SEQ ID NO: 10239 - protein, 1036 aa, Homo Sapiens
MGFALERFAEAVDPALECKLCGQVLEEPLCTPCGHVFCASCLLPWAVRRRRCPLQCQPLAPGELYRVLPLRSLIQKLRVQCDYRARGCGHSVRLHELEAHVEHCDFGPARRLRSRGGCASGLGGGEVPARGGCGPTPRAGRGGGARGGPPGGRWGRGRGPGPRVLAWRRREKALLAQLWALQGEVQLTARRYQEKFTQYMAHVRNFVGDLGGGHRRDGEHKPFTIVLERENDTLGFNIIGGRPNQNNQEGTSTEGIYVSKILENGPADRADGLEIHDKIMEVNGKDLSKATHEEAVEAFRNAKEPIVVQVLRRTPLSRPAYGMASEVQLMNASTQTDITFEHIMALAKLRPPTPPVPDICPFLLSDSCHSLHPMEHEFYEDNEYISSLPADADRTEDFEYEEVELCRVSSQEKLGLTVCYRTDDEEDTGIYVSEVDPNSIAAKDGRIREGDRILQINGEDVQNREEAVALLSNDECKRIVLLVARPEIQLDEGWLEDERNEFLEELNLEMLEEEHNEAMQPTANEVEQPKKQEEEEGTTDTATSSSNNHEKDSGVGRTDESLRNDESSEQENAAEDPNSTSLKSKRDLGQSQDTLGSVELQYNESLVSGEYIDSDCIGNPDEDCERFRQLLELKCKIRNHGEYDLYYSSSTIECNQGEQEGVEHELQLLNEELRNIELECQNIMQAHRLQKVTDQYGDIWTLHDGGFRNYNTSIDMQRGKLDDIMEHPEKSDKDSSSAYNTAESCRSTPLTVDRSPDSSLPRVINLTNKKNLRSTMAATQSSSGQSSKESTSTKAKTTEQGCSAESKEKVLEGSKLPDQEKAVSEHIPYLSPYHSSSYRYANIPAHARHYQSYMQLIQQKSAVEYAQSQLSLVSMCKESQKCSEPKMEWKVKIRSDGTRYITKRPVRDRILKERALKIKEERSGMTTDDDTMSEMKMGRYWSKEERKQHLVRAKEQRRRREFMMRSRLECLKESPQSGSEGKKEINIIELSHKKMMKKRNKKILDNWMTIQELMTHGAKSPDGTRVHNAFLSVTTV

SEQ ID NO: 10240 - protein, 776 aa, Homo Sapiens
MSGKRQFFLKPLALLTCWPSTVNGKDLSKATHEEAVEAFRNAKEPIVVQVLRRTPLSRPAYGMASEVQLMNASTQTDITFEHIMALAKLRPPTPPVPDICPFLLSDSCHSLHPMEHEFYEDNEYISSLPADADRTEDFEYEEVELCRVSSQEKLGLTVCYRTDDEEDTGIYVSEVDPNSIAAKDGRIREGDRILQINGEDVQNREEAVALLSNDECKRIVLLVARPEIQLDEGWLEDERNEFLEELNLEMLEEEHNEAMQPTANEVEQPKKQEEEEGTTDTATSSSNNHEKDSGVGRTDESLRNDESSEQENAAEDPNSTSLKSKRDLGQSQDTLGSVELQYNESLVSGEYIDSDCIGNPDEDCERFRQLLELKCKIRNHGEYDLYYSSSTIECNQGEQEGVEHELQLLNEELRNIELECQNIMQAHRLQKVTDQYGDIWTLHDGGFRNYNTSIDMQRGKLDDIMEHPEKSDKDSSSAYNTAESCRSTPLTVDRSPDSSLPRVINLTNKKNLRSTMAATQSSSGQSSKESTSTKAKTTEQGCSAESKEKVLEGSKLPDQEKAVSEHIPYLSPYHSSSYRYANIPAHARHYQSYMQLIQQKSAVEYAQSQLSLVSMCKESQKCSEPKMEWKVKIRSDGTRYITKRPVRDRILKERALKIKEERSGMTTDDDTMSEMKMGRYWSKEERKQHLVRAKEQRRRREFMMRSRLECLKESPQSGSEGKKEINIIELSHKKMMKKRNKKILDNWMTIQELMTHGAKSPDGTRVHNAFLSVTTV

SEQ ID NO: 10241 - protein, 77 aa, Homo Sapiens
MSPPLCPLLLLAVGLRLAGTLNPSDPNTCSFWESFTTTTKESHSRPFSLLPSEPCERPWEGPHTCPQPTNSEETPGF

SEQ ID NO: 10242 - protein, 173 aa, Homo Sapiens
MSPPLCPLLLLAVGLRLAGTLNPSDPNTCSFWESFTTTTKESHSRPFSLLPSEPCERPWEGPHTCPQPTVVYRTVYRQVVKTDHRQRLQCCHGFYESRGFCVPLCAQECVHGRCVAPNQCQCVPGWRGDDCSSECAPGMWGPQCDKPCSCGNNSSCDPKSGVCSCPSGLQPPN

SEQ ID NO: 10243 - protein, 1037 aa, Homo Sapiens
MSPPLCPLLLLAVGLRLAGTLNPSDPNTCSFWESFTTTTKESHSRPFSLLPSEPCERPWEGPHTCPQPTVVYRTVYRQVVKTDHRQRLQCCHGFYESRGFCVPLCAQECVHGRCVAPNQCQCVPGWRGDDCSSECAPGMWGPQCDKPCSCGNNSSCDPKSGVCSCPSGLQPPNCLQPCTPGYYGPACQFRCQCHGAPCDPQTGACFCPAERTGPSCDVSCSQGTSGFFCPSTHSCQNGGVFQTPQGSCSCPPGWMGTICSLPCPEGFHGPNCSQECRCHNGGLCDRFTGQCRCAPGYTGDRCREECPVGRFGQDCAETCDCAPDARCFPANGACLCEHGFTGDRCTDRLCPDGFYGLSCQAPCTCDREHSLSCHPMNGECSCLPGWAGLHCNESCPQDTHGPGCQEHCLCLHGGVCQATSGLCQCAPGYTGPHCASLCPPDTYGVNCSARCSCENAIACSPIDGECVCKEGWQRGNCSVPCPPGTWGFSCNASCQCAHEAVCSPQTGACTCTPGWHGAHCQLPCPKGQFGEGCASRCDCDHSDGCDPVHGRCQCQAGWMGARCHLSCPEGLWGVNCSNTCTCKNGGTCLPENGNCVCAPGFRGPSCQRSCQPGRYGKRCVPCKCANHSFCHPSNGTCYCLAGWTGPDCSQPCPPGHWGENCAQTCQCHHGGTCHPQDGSCICPLGWTGHHCLEGCPLGTFGANCSQPCQCGPGEKCHPETGACVCPPGHSGAPCRIGIQEPFTVMPTTPVAYNSLGAVIGIAVLGSLVVALVALFIGYRHWQKGKEHHHLAVAYSSGRLDGSEYVMPDVPPSYSHYYSNPSYHTLSQCSPNPPPPNKVPGPLFASLQNPERPGGAQGHDNHTTLPADWKHRREPPPGPLDRGSSRLDRSYSYSYSNGPGPFYNKGLISEEELGASVASLSSENPYATIRDLPSLPGGPRESSYMEMKGPPSGSPPRQPPQFWDSQRRRQPQPQRDSGTYEQPSPLIHDRDSVGSQPPLPPGLPPGHYDSPKNSHIPGHYDLPPVRHPPSPPLRRQDR

SEQ ID NO: 10244 - protein, 1037 aa, Homo Sapiens; identical to SEQ ID NO: 10243

SEQ ID NO: 10245 - protein, 227 aa, Homo Sapiens
MGWTMRLVTAALLLGLMMVVTGDEDENSPCAHEALLDEDTLFCQGLEVFYPELGNIGCKVVPDCNNYRQKITSWMEPIVKFPGAVDGATYILVMVDPDAPSRAEPRQRFWRHWLVTDIKGADLKKGKIQGQELSAYQAPSPPAHSGFHRYQFFVYLQEGKVISLLPKENKTRGSWKMDRFLNRFHLGEPEASTQFMTQNYQDSPTLQAPRERASEPKHKNQAEIAAC

SEQ ID NO: 10246 - protein, 93 aa, Homo Sapiens
MSRRRAEPGCGGSGRRAGAPGEGRGRRRYAPGPAAKALPRRRLALQSQVPMGWTMRLVTAALLLGLMMVVTGDEDENSPCAHEALLDEDTLFC

SEQ ID NO: 10247 - protein, 135 aa, Homo Sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRV

SEQ ID NO: 10248 - protein, 230 aa, Homo Sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVT

SEQ ID NO: 10249 - protein, 738 aa, Homo Sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPDAVESRYSRTEGSLDGT

SEQ ID NO: 10250 - protein, 184 aa, Homo Sapiens [sequence omitted]

SEQ ID NO: 10251 - protein, 88 aa, Homo Sapiens
FLTLCTWLLLLGPGLLATVRAECSQDCATCSYRLVRPADINFLKHPRIDQFIHSTNEYLMEEAPDGGKSQCNASKWRHGVLMEKQQDL

SEQ ID NO: 10252 - protein, 105 aa, Homo Sapiens
MARFLTLCTWLLLLGPGLLATVRAECSQDCATCSYRLVRPADINFLACVMECEGKLPSLKIWETCKELLQLSKPELPQDGTSTLRENSKPEESHLLAKRYGGFMK

SEQ ID NO: 10253 - protein, 267 aa, Homo Sapiens
MARFLTLCTWLLLLGPGLLATVRAECSQDCATCSYRLVRPADINFLACVMECEGKLPSLKIWETCKELLQLSKPELPQDGTSTLRENSKPEESHLLAKRYGGFMKRYGGFMKKMDELYPMEPEEEANGSEILAKRYGGFMKKDAEEDDSLANSSDLLKELLETGDNRERSHHQDGSDNEEEVSKRYGGFMRGLKRSPQLEDEAKELQKRYGGFMRRVGRPEWWMDYQKRYGGFLKRFAEALPSDEEGESYSKEVPEMEKRYGGFMRF

SEQ ID NO: 10254 - protein, 267 aa, Homo Sapiens; identical to SEQ ID NO: 10253

SEQ ID NO: 10255 - protein, 79 aa, Homo Sapiens
MARFLTLCTWLLLLGPGLLATVRAECSQDCATCSYRLVRPADINFLDCGGGEEEGCSFQNFPYCFLCSCCYHLLLLSLL

SEQ ID NO: 10256 - protein, 92 aa, Homo Sapiens
MARFLTLCTWLLLLGPGLLATVRAECSQDCATCSYRLVRPADINFLVSVARGECCAPCETEFPQQYADCLRPTARRVWRFAPGRSRSGASPW

SEQ ID NO: 10257 - protein, 81 aa, Homo Sapiens
MSRSSKVVLGLSVLLTAATVAGVHVKQQWDQQRLRDGVIRDIERQIRKKENIRLLGEQIILTEQLEAEREKMLLAKGSQKS

SEQ ID NO: 10258 - protein, 101 aa, Homo Sapiens
MSSAAGFCASRPGLLFLGLLLLPLVVAFASAEAEEDGDLQCLCVKTTSQVRPRHITSLEVIKAGPHCPTAQLIATLKNGRKICLDLQAPLYKKIIKKLLES

SEQ ID NO: 10259 - protein, 104 aa, Homo Sapiens
MSSAARSRLTRATRQEMLFLALLLLPVVVAFARAEAEEDGDLQCLCVKTTSQVRPRHITSLEVIKAGPHCPTAQLIATLKNGRKICLDLQALLYKKIIKEHLES

SEQ ID NO: 10260 - protein, 776 aa, Homo Sapiens
MCGYERCRPCRGAHGYLRGGQGVLHLRGLPGHGGRRLKHRRGRLGECLQHPASGAVRGDWREKPGCWSHRFPCPGRHALVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 10261 - protein, 784 aa, Homo Sapiens
MDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 10262 - protein, 202 aa, Homo Sapiens
MGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 10263 - protein, 118 aa, Homo Sapiens
MGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALL

SEQ ID NO: 10264 - protein, 240 aa, Homo Sapiens
MGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKG

SEQ ID NO: 10265 - protein, 113 aa, Homo Sapiens
MNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARN

SEQ ID NO: 10266 - protein, 210 aa, Homo Sapiens
MNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGW

SEQ ID NO: 10267 - protein, 166 aa, Homo Sapiens
  misc_feature (1)..(1): Xaa can be any naturally occurring amino acid
XADGHRMLAIYDGFDGFAKGQIKEIGWTDVGGWTGQGGSILGTKRVLPGKYLEEIATQMRTHSINALLIIGGFEAYKSACDMAEARGRHQELCIPLCVVPATISNNVPGTEISLGSDTGLNAVVETCDRIKQSASGTKRRVFIIETMGGYCGYLANMGGLAAGADA

SEQ ID NO: 10268 - protein, 103 aa, Homo Sapiens
  misc_feature (1)..(1): Xaa can be any naturally occurring amino acid
XFIYQLYSEEGKGVFDCRKNVLGHMQQGGAPSPFDRNFGTKISARAMEWITAKLKEARGRGKKFTTDDSICVLGISKRNVIFQPVAELKKQTDFETVSMQPPR

SEQ ID NO: 10269 - protein, 140 aa, Homo Sapiens
MAGWNAYIDNLMADGTCQDAAIVGYKDSPSVWAAVPGKTFVNITPAEVGVLVGKDRSSFYVNGLTLGGQKCSVIRDSLLQDGEFSMDLRTKSTGGAPTFNVTVTKTDKTLVLLMGKEGVHGGLINKKCYEMASHLRRSQY

SEQ ID NO: 10270 - protein, 104 aa, Homo Sapiens
MGAWFLFQPAEVGVLVGKDRSSFYVNGLTLGGQKCSVIRDSLLQDGEFSMDLRTKSTGGAPTFNVTVTKTDKTLVLLMGKEGVHGGLINKKCYEMASHLRRSQY

SEQ ID NO: 10271 - protein, 165 aa, Homo Sapiens
MHSRPRRRRRRGHTRRRPPVLPFGGGSGGARAAAQRAEPRSGRQRVPRALRLPPPASRGSSSPVRGPSSSAESSPSSSAMAGWNAYIDNLMADGTCQDAAIVGYKDSPSVWAAVPGKTFVNITPAEVGVLVGKDRSSFYVNGLTLGGQKCSVIRDSLLQDGEFSM

SEQ ID NO: 10272 - protein, 265 aa, Homo Sapiens
MEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYIL

SEQ ID NO: 10273 - protein, 388 aa, Homo Sapiens
MKWLLLLGLVALSECIMYKVPLIRKKSLRRTLSERGLLKDFLKKHNLNPARKYFPQWKAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 10274 - protein, 128 aa, Homo Sapiens
MNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 10275 - protein, 234 aa, Homo Sapiens
MVSGNNSDSAHCIGTGLRGKETTLVTPQDSPRKCPIKGSPEEATADGHTNGRTKKFMSSPLTFHSDDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 10276 - protein, 388 aa, Homo Sapiens
MKWLLLLGLVALSECIMYKVPLIRKKSLRRTLSERGLLKDFLKKHNLNPARKYFPQWEAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 10277 - protein, 128 aa, Homo Sapiens; identical to SEQ ID NO: 10274

SEQ ID NO: 10278 - protein, 234 aa, Homo Sapiens; identical to SEQ ID NO: 10275

SEQ ID NO: 10279 - protein, 388 aa, Homo Sapiens
MKWLLLLGLVALSECIMYKVPLIRKKSLRRTLSERGLLKDFLKKHNLNPARKYFPQWEAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDKSGSVVIFGGIDSSYYTGSLNWVPVTVEGYWQITVDSITMNGETIACAEGCQAIVDTGTSLLTGPTSPIANIQSDIGASENSDGDMVVSCSAISSLPDIVFTINGVQYPVPPSAYILQSEGSCISGFQGMNVPTESGELWILGDVFIRQYFTVFDRANNQVGLAPVA

SEQ ID NO: 10280 - protein, 128 aa, Homo Sapiens
MNGETIACAEGCQAIVDTGTSLLTGPTSPIANIQSDIGASENSDGDMVVSCSAISSLPDIVFTINGVQYPVPPSAYILQSEGSCISGFQGMNVPTESGELWILGDVFIRQYFTVFDRANNQVGLAPVA

SEQ ID NO: 10281 - protein, 234 aa, Homo Sapiens
MVSGNNSDGAHCMGPGLRGKETTLVTPQDSPGKCPINGRSEEATADGHTNGRTKKFMSSPLTFHSDDKSGSVVIFGGIDSSYYTGSLNWVPVTVEGYWQITVDSITMNGETIACAEGCQAIVDTGTSLLTGPTSPIANIQSDIGASENSDGDMVVSCSAISSLPDIVFTINGVQYPVPPSAYILQSEGSCISGFQGMNVPTESGELWILGDVFIRQYFTVFDRANNQVGLAPVA

SEQ ID NO: 10282 - protein, 289 aa, Homo Sapiens
MAFRQALQLAACGLAGGSAAVLFSAVAVGKPRAGGDAEPRPAEPPAWAGGARPGPGVWDPNWDRREPLSLINVRKRNVESGEEELASKLDHYKAKATRHIFLIRHSQYHVDGSLEKDRTLTPLGREQAELTGLRLASLGLKFNKIVHSSMTRAIETTDIISRHLPGVCKVSTDLLREGAPIEPDPPVSHWKPEAVQYYEDGARIEAAFRNYIHRADARQEEDSYEIFICHANVIRYIVCRALQFPPEGWLRLSLNNGSITHLVIRPNGRVALRTLGDTGFMPPDKITRS

SEQ ID NO: 10283 - protein, 255 aa, Homo Sapiens
MAFRQALQLAACGLAGGSAAVLFSAVAVGKPRAGGDAEPRPAEPPAWAGGARPGPGVWDPNWDRREPLSLINVRKRNVESGEEELASKLDHYKAKATRHIFLIRHSQYHVDGSLEKDRTLTPLGREQAELTGLRLASLGLKFNKIVHSSMTRAIETTDIISRHLPGVCKVSTDLLREGAPIEPDPPVSHWKPEAVQYYEDGARIEAAFRNYIHRADARQEEDSYEIFICHANVIRYIVCSIPPLLSAGDFVLLGS

SEQ ID NO: 10284 - protein, 140 aa, Homo Sapiens
MTRAIETTDIISRHLPGVCKVSTDLLREGAPIEPDPPVSHWKPEAVQYYEDGARIEAAFRNYIHRADARQEEDSYEIFICHANVIRYIVCRALQFPPEGWLRLSLNNGSITHLVIRPNGRVALRTLGDTGFMPPDKITRS

SEQ ID NO: 10285 - protein, 140 aa, Homo Sapiens; identical to SEQ ID NO: 10284

SEQ ID NO: 10286 - protein, 269 aa, Homo Sapiens
MAGLAARLVLLAGAAALASGSQGDREPVYRDCVLQCEEQNCSGGALNHFRSRQPIYMSLAGWTCRDDCKYECMWVTVGLYLQEGHKVPQFHGKVSLNAWFWSTVFHTRDTDLTEKMDYFCASTVILHSIYLCCVRTVGLQHPAVVSAFRALLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 10287 - protein, 299 aa, Homo Sapiens
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWKMDYFCASTVILHSIYLCCVRTVGLQHPAVVSAFRALLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 10288 - protein, 148 aa, Homo Sapiens
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWLSGR

SEQ ID NO: 10289 - protein, 320 aa, Homo Sapiens
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWVSLNAWFWSTVFHTRDTDLTEKMDYFCASTVILHSIYLCCVRTVGLQHPAVVSAFRALLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 10290 - protein, 240 aa, Homo Sapiens
MKDVGPESCGQPTPCWPSPALESVLGKASQHLGLESGQPLYLLELNWGGTECALSSTGRTAACFLPISLLPTSPAAWLGPEALCLPGRPGTTGLRDTGGPLLLPPPTLLQDTTRWCWMLVLWPAKVHGDSPHGILRDQAAGIGKEFHPDHCPSQVPRRPHHTPFQGQGSSKPRARILCCCLVESLPPCVGSVGQAECIGDRAVSMGLGVCELRPRCAVWRRVLSGKRCGFKVCVCRGWVC

SEQ ID NO: 10291 - protein, 70 aa, Homo Sapiens
MWVTVGLYLQEGHKVPQFHGKWPFSRFLFFQEPASAVASFLNGLASLVMLCRYRTFVPASSPMYHTCVAF

SEQ ID NO: 10292 - protein, 44 aa, Homo Sapiens
SFLNGLASLVMLCRYRTFVPASSPMYHTCVAFAWMRKLRHSKAK

SEQ ID NO: 10293 - protein, 150 aa, Homo Sapiens
  misc_feature (1)..(1): Xaa can be any naturally occurring amino acid
XARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWMRKLRHSKAK

SEQ ID NO: 10294 - protein, 86 aa, Homo Sapiens
MCLHPSSTPPFHQPRKEAVICKQRVPLKKFKSIRETMKEKGLLGEFLRTHKYDPAWKYRFGDLSVTYEPMAYMDAAYFGEISIGTP

SEQ ID NO: 10295 - protein, 315 aa, Homo Sapiens
MKWMVVVLVCLQLLEAAVVKVPLKKFKSIRETMKEKGLLGEFLRTHKYDPAWKYRFGDLSVTYEPMAYMDAAYFGEISIGTPPQNFLVLFDTGSSNLWVPSVYCQSQACTSHSRFNPSESSTYSTNGQTFSLQYGSGSLTGFFGYDTLTVQSIQVPNQEFGLSENEPGTNFVYAQFDGIMGLAYPALSVDEATTAMQGMVQEGALTSPVFSVYLSNLVLESSGLGPLLTPSRAAPPSSTLQLPEKPLEQTWNILTPFTKTLPVSNLSRKVTSWAGVGIPVTCLPEAGSGGERRAECGLGVPTTRGPPRSQHHSGA

SEQ ID NO: 10296 - protein, 388 aa, Homo Sapiens
MKWMVVVLVCLQLLEAAVVKVPLKKFKSIRETMKEKGLLGEFLRTHKYDPAWKYRFGDLSVTYEPMAYMDAAYFGEISIGTPPQNFLVLFDTGSSNLWVPSVYCQSQACTSHSRFNPSESSTYSTNGQTFSLQYGSGSLTGFFGYDTLTVQSIQVPNQEFGLSENEPGTNFVYAQFDGIMGLAYPALSVDEATTAMQGMVQEGALTSPVFSVYLSNQQGSSGGAVVFGGVDSSLYTGQIYWAPVTQELYWQIGIEEFLIGGQASGWCSEGCQAIVDTGTSLLTVPQQYMSALLQATGAQEDEYGQFLVNCNSIQNLPSLTFIINGVEFPLPPSSYILSNNGYCTVGVEPTYLSSQNGQPLWILGDVFLRSYYSVYDLGNNRVGFATAA

SEQ ID NO: 10297 - protein, 140 aa, Homo Sapiens [sequence omitted]

SEQ ID NO: 10298 - protein, 221 aa, Homo Sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRHSPGRQSPDMPGDFRADAPSFLPPRRSLPMLFRMEWGCALTGSQSAVWPSSPVPEEIPRMHPGRNGKKQQRKPLREKMKPERCGDAVPRR

SEQ ID NO: 10299 - protein, 149 aa, Homo Sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERCGDAVPRR

SEQ ID NO: 10300 - protein, 170 aa, Homo Sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERRRPKGRGKRRREKQRPTDCHLCGDAVPRR

SEQ ID NO: 10301 - protein, 169 aa, Homo Sapiens
MPVMRLFPCFLQLLAGLALPAVPPQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERRRPKGRGKRRREKQRPTDCHLCGDAVPRR

SEQ ID NO: 10302 - protein, 196 aa, Homo Sapiens
MSRRSMLLAWALPSLLRLGAAQETEDPACCSPIVPRNEWKALASECAQHLSLPLRYVVVSHTAGSSCNTPASCQQQARNVQHYHMKTLGWCDVGYNFLIGEDGLVYEGRGWNFTGAHSGHLWNPMSIGISFMGNYMDRVPTPQAIRAAQGLLACGVAQGALRSNYVLKGHRDVQRTLSPGNQLYHLIQNWPHYRSP

SEQ ID NO: 10303 - protein, 105 aa, Homo Sapiens
MAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREG

SEQ ID NO: 10304 - protein, 634 aa, Homo Sapiens
MAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREGKEYGVVLAPDGSTVAVEPLLAGLEAGLQGRRVINLPLDSMAAPWETGDTFPDVVAIAPDVRATSSPGLRDGSPDVTTADIGANTPDATKGCPDVQASLPDAKAKSPPTMVDSLLAVTLAGNLGLTFLRGSQTQSHPDLGTEGCWDQLSAPRTFTLLDPKASLLTMAFLNGALDGVILGDYLSRTPEPRPSLSHLLSQYYGAGVARDPGFRSNFRRQNGAALTSASILAQQVWGTLVLLQRLEPVHLQLQCMSQEQLAQVAANATKEFTEAFLGCPAIHPRCRWGAAPYRGRPKLLQLPLGFLYVHHTYVPAPPCTDFTRCAANMRSMQRYHQDTQGWGDIGYSFVVGSDGYVYEGRGWHWVGAHTLGHNSRGFGVAIVGNYTAALPTEAALRTVRDTLPSCAVRAGLLRPDYALLGHRQLVRTDCPGDALFDLLRTWPHFTAVSLRSLHYTARRPSVYTSSTRPLPPACNSCARTASARPPTSRRHVYSGNLGPAFAGHSAGNIPDPVTSAYAASAQPQTQPACPFPSS

SEQ ID NO: 10305 - protein, 576 aa, Homo Sapiens
MAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREGKEYGVVLAPDGSTVAVEPLLAGLEAGLQGRRVINLPLDSMAAPWETGDTFPDVVAIAPDVRATSSPGLRDGSPDVTTADIGANTPDATKGCPDVQASLPDAKAKSPPTMVDSLLAVTLAGNLGLTFLRGSQTQSHPDLGTEGCWDQLSAPRTFTLLDPKASLLTMAFLNGALDGVILGDYLSRTPEPRPSLSHLLSQYYGAGVARDPGFRSNFRRQNGAALTSASILAQQVWGTLVLLQRLEPVHLQLQCMSQEQLAQVAANATKEFTEAFLGCPAIHPRCRWGAAPYRGRPKLLQLPLGFLYVHHTYVPAPPCTDFTRCAANMRSMQRYHQDTQGWGDIGYSFVVGSDGYVYEGRGWHWVGAHTLGHNSRGFGVAIVGNYTAALPTEAALRTVRDTLPSCAVRAGLLRPDYALLGHRQLVRTDCPGDALFDLLRTWPHFTATVKPRPARSVSKRSRREPPPRTLPATDLQ

SEQ ID NO: 10306 - protein, 181 aa, Homo Sapiens
MGTRRRGRTFHCQPSTAEVLCRGQPEIPLGSWNPATMAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREGKEYGVVLAPDGSTVAVEPLLAGLEAGLQGRRVINLPLDSM

SEQ ID NO: 10307 - protein, 341 aa, Homo Sapiens
MGTLPWLLAFFILGLQAWDTPTIVSRKEWGARPLACRALLTLPVAYIITDQLPGMQCQQQSVCSQMLRGLQSHSVYTIGWCDVAYNFLVGDDGRVYEGVGWNIQGLHTQGYNNISLGIAFFGNKIGSSPSPAALSAAEGLISYAIQKGHLSPRYIQPLLLKEETCLDPQHPVMPRKVCPNIIKRSAWEARETHCPKMNLPAKYVIIIHTAGTSCTVSTDCQTVVRNIQSFHMDTRNFCDIGYHFLVGQDGGVYEGVGWHIQGSHTYGFNDIALGIAFIGYFVEKPPNAAALEAAQDLIQCAVVEGYLTPNYLLMGHSDVVNILSPGQALYNIISTWPHFKH

SEQ ID NO: 10308 - protein, 369 aa, Homo Sapiens
MLPWLLVFSALGIQAWGDSSWNKTQAKQVSEGLQYLFENISQLTEKDVSTTVSRKAWGAEAVGCSIQLTTPVNVLVIHHVPGLECHDQTVCSQRLRELQAHHVHNNSGCDVAYNFLVGDDGRVYEGVGWNIQGVHTQGYNNISLGFAFFGTKKGHSPSPAALSAMENLITYAVQKGHLSSSYVQPLLGKGENCLAPRQKTSLKKACPGVVPRSVWGARETHCPRMTLPAKYGIIIHTAGRTCNISDECRLLVRDIQSFYIDRLKSCDIGYNFLVGQDGAIYEGVGWNVQGSSTPGYDDIALGITFMGTFTGIPPNAAALEAAQDLIQCAMVKGYLTPNYLLVGHSDVARTLSPGQALYNIISTWPHFKH

SEQ ID NO: 10309 - protein, 373 aa, Homo Sapiens
MLPWLLVFSALGIQAWGDSSWNKTQAKQVSEGLQYLFENISQLTEKGLPTDVSTTVSRKAWGAEAVGCSIQLTTPVNVLVIHHVPGLECHDQTVCSQRLRELQAHHVHNNSGCDVAYNFLVGDDGRVYEGVGWNIQGVHTQGYNNISLGFAFFGTKKGHSPSPAALSAMENLITYAVQKGHLSSSYVQPLLGKGENCLAPRQKTSLKKACPGVVPRSVWGARETHCPRMTLPAKYGIIIHTAGRTCNISDECRLLVRDIQSFYIDRLKSCDIGYNFLVGQDGAIYEGVGWNVQGSSTPGYDDIALGITFMGTFTGIPPNAAALEAAQDLIQCAMVKGYLTPNYLLVGHSDVARTLSPGQALYNIISTWPHFKH

SEQ ID NO: 10310 - protein, 580 aa, Homo Sapiens
MDYPKMDYFLDVESAHRLLDVESAQRFFYSQGAQARRATLLLPPTLMAASSEDDIDRRPIRRVRSKSDTPYLAEARISFNLGAAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRRLSQRPTAEELEQRNILKPRNEQEEQEEKREIKRRLTRKLSQRPTVEELRERKILIRFSDYVEVADAQDYDRRADKPWTRLTAADKAAIRKELNEFKSTEMEVHELSRHLTRFHRP

SEQ ID NO: 10311 - protein, 484 aa, Homo Sapiens
MDYPKMDYFLDVESAHRLLDVESAQRFFYSQGAQARRATLLLPPTLMAASSEDDIDRRPIRRVRSKSDTPYLAEARISFNLGAAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRRLSQRPTAEELEQRNILKRK

SEQ ID NO: 10312 - protein, 169 aa, Homo Sapiens
MDYPKMDYFLDVESAHRLLDVESAQRFFYSQGAQARRATLLLPPTLMAASSEDDIDRRPIRRVRSKSDTPYLAEARISFNLGAGVSLFGDMDEARMGPAVPTLGRPLGLELCSLENHGLLKTAPTYTTSAHICSGPSTGGQFSTQGMSPVQGAKRRRVVWLPLEGEEFG

SEQ ID NO: 10313 - protein, 144 aa, Homo Sapiens
MYLQGPRKLMTQGGYDMVQKLFLDFFRRRLSQRPTAEELEQRNILKPRNEQEEQEEKREIKRRLTRKLSQRPTVEELRERKILIRFSDYVEVADAQDYDRRADKPWTRLTAADKAAIRKELNEFKSTEMEVHELSRHLTRFHRP

SEQ ID NO: 10314 - protein, 140 aa, Homo Sapiens
MYLQGPRKLMTQGGYDMVQKLFLDFFRRRLSQRPTAEELEQRNILKPRNEQEEQEEKREIKRRLTRKLSQRPTVEELRERKILIRFSDYVEVADAQDYDRRADKPWTRLTAADKVSRGECWRVGGRTVCWVSLGSPLGSV

SEQ ID NO: 10315 - protein, 230 aa, Homo Sapiens
NLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPVSEESPSASESGVLLSQDPSAKPVLLLPPKKPAAFPGDHEETPVKQLPLLKQPPALPPKPTTRIANHLTDWHQAHQVGQRHPLPPWQWAFSSPGSSKRIQSRPGAVAYACNPSTLGGRGRWIT

SEQ ID NO: 10316 - protein, 265 aa, Homo Sapiens
  misc_feature (1)..(1): Xaa can be any naturally occurring amino acid
XSPFTPFSPLLSFFLSPFFFLFPSLSHSLPTPSLPLPSPFPSPSPVREPLPLPSSPFRLSPSPSVSFSLSARRATLLLPPTLMAASSEDDIDRRPIRRVRSKSDTPYLAEARISFNLGAAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPVSEESPSA

SEQ ID NO: 10317 - protein, 124 aa, Homo Sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITT

SEQ ID NO: 10318 - protein, 201 aa, Homo Sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVE

SEQ ID NO: 10319 - protein, 202 aa, Homo Sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEK

SEQ ID NO: 10320 - protein, 216 aa, Homo Sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQQKKAAIISAEG

SEQ ID NO: 10321 - protein, 246 aa, Homo Sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQQKKAAIISAEGDSKAAELIANSLATAGDGLIELRKLEAAED

SEQ ID NO: 10322 - protein, 272 aa, Homo Sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQQKKAAIISAEGDSKAAELIANSLATAGDGLIELRKLEAAEDIAYQLSRSRNITYLPAGQSVLLQLPQ

SEQ ID NO: 10323 - protein, 272 aa, Homo Sapiens; identical to SEQ ID NO: 10322

SEQ ID NO: 10324 - protein, 272 aa, Homo Sapiens; identical to SEQ ID NO: 10322

SEQ ID NO: 10325 - protein, 155 aa, Homo Sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITYLPAGQSVLLQLPQ

SEQ ID NO: 10326 - protein, 258 aa, Homo Sapiens
MIAISAVSSALLFSLLCEASTVVLLNSTDSSPPTNNFTDIEAALKAQLDSADIPKARRKRYISQNDMIAILDYHNQVRGKVFPPAANMEYMVWDENLAKSAEAWAATCIWDHGPSYLLRFLGQNLSVRTGRYRSILQLVKPWYDEVKDYAFPYPQDCNPRCPMRCFGPMCTHYTQMVWATSNRIGCAIHTCQNMNVWGSVWRRAVYLVCNYAPKGNWIGEAPYKVGVPCSSCPPSYGGSCTDNLCFPGVTSNYLYWFK

SEQ ID NO: 10327 - protein, 258 aa, Homo Sapiens; identical to SEQ ID NO: 10326

SEQ ID NO: 10328 - protein, 117 aa, Homo Sapiens
MRASSFLIVVVFLIAGTLVLEAAVTGVPVKGQDTVKGRVPFNGQDPVKGQVSVKGQDKVKAQEPVKGPVSTKPGSCPIILIRCAMLNPPNRCLKDTDCPGIKKCCEGSCGMACFVPQ

SEQ ID NO: 10329 - protein, 77 aa, Homo Sapiens [sequence omitted]

SEQ ID NO: 10330 - protein, 111 aa, Homo Sapiens
MESRMWPALLLSHLLPLWPLLLLPLPPPAQGSSSSPRTPPAPARPPCARGGPSAPRHVCVWERAPPPSRSPRVPRSRRQVLPGTAPPATPSGFEEGPPSSQYPWAIVWGPT

SEQ ID NO: 10331 - protein, 172 aa, Homo Sapiens
MESRMWPALLLSHLLPLWPLLLLPLPPPAQGSSSSPRTPPAPARPPCARGGPSAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGDGLILGEAPATLRPFLFGGR

SEQ ID NO: 10332 - protein, 282 aa, Homo Sapiens
MESRMWPALLLSHLLPLWPLLLLPLPPPAQGSSSSPRTPPAPARPPCARGGPSAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGDGLILGEAPATLRPFLFGGRGEGVDPQLYVTITISIIIVLVATGIIFKFCWDRSQKRRRPSGQQGALRQEESQQPLTDLSPAGVTVLGAFGDSPTPTPDHEEPRGGPRPGMPHPKGAPAFQLNRIPLVNL

SEQ ID NO: 10333 - protein, 282 aa, Homo Sapiens; identical to SEQ ID NO: 10332

SEQ ID NO: 10334 - protein, 276 aa, Homo Sapiens
MESRMWPALLLSHLLPLWPLLLLPLPPPAQGSSSSPRTPPAPARPPCARGGPSAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGDGLILGEAPATLRPFLFGGRGEGVDPQLYVTITISIIIVLVATGIIFKFCWDRSQKRRRPSGQQGALRQEESQQPLTDLSPAGVTVLGAFGDSPTPTPDHEEPRGGPRPGMPHPKGAPAFQLNR

SEQ ID NO: 10335 - protein, 27 aa, Homo Sapiens
KNMELNVYGDDVEVDYRSYEGMVEMVS

SEQ ID NO: 10336 - protein, 395 aa, Homo Sapiens
MAVTDSLSRAATVLATVLLLSFGSVAASHIEDQAEQFFRSGHTNNWAVLVCTSRFWFNYRHVANTLSVYRSVKRLGIPDSHIVLMLADDMACNPRNPKPATVFSHKNMELNVYGDDVEVDYRSYEVTVENFLRVLTGRIPPSTPRSKRLLSDDRSNILIYMTGHGGNGFLKFQDSEEITNIELADAFEQMWQKRRYNELLFIIDTCQGASMYERFYSPNIMALASSQVGEDSLSHQPDPAIGVHLMDRYTFYVLEFLEEINPASQTNMNDLFQVCPKSLCVSTPGHRTDLFQRDPKNVLITDFFGSVRKVEITTETIKLQQDSEIMESSYKEDQMDEKLMEPLKYAEQLPVAQIIHQKPKLKDWHPPGGFILGLWALIIMVFFKTYGIKHMKFIF

SEQ ID NO: 10337 - protein, 332 aa, Homo Sapiens
MAVTDSLSRAATVLATVLLLSFGSVAASHIEDQAEQFFRSGHTNNWAVLVCTSRFWFNYRHVANTLSVYRSVKRLGIPDSHIVLMLADDMACNPRNPKPATVFSHKNMELNVYGDDVEVDYRSYEVTVENFLRVLTGRIPPSTPRSKRLLSDDRSNILIYMTGHGGNGFLKFQDSEEITNIELADAFEQMWQKRRYNELLFIIDTCQGASMYERFYSPNIMALASSQVGEDSLSHQPDPAIGVHLMDRYTFYVLEFLEEINPASQTNMNDLFQVCPKSLCVSTPGHRTDLFQRDPKNVLITDFFGSVRKVEITTETIKLQQDSEIMESRYSS

SEQ ID NO: 10338 - protein, 301 aa, Homo Sapiens
MAVTDSLSRAATVLATVLLLSFGSVAASHIEVTVENFLRVLTGRIPPSTPRSKRLLSDDRSNILIYMTGHGGNGFLKFQDSEEITNIELADAFEQMWQKRRYNELLFIIDTCQGASMYERFYSPNIMALASSQVGEDSLSHQPDPAIGVHLMDRYTFYVLEFLEEINPASQTNMNDLFQVCPKSLCVSTPGHRTDLFQRDPKNVLITDFFGSVRKVEITTETIKLQQDSEIMESSYKEDQMDEKLMEPLKYAEQLPVAQIIHQKPKLKDWHPPGGFILGLWALIIMVFFKTYGIKHMKFIF

SEQ ID NO: 10339 - protein, 101 aa, Homo Sapiens
MEAMWLLCVALAVLAWGFLWVWDSSERMKSREQGGRLGAESRTLLVIAHPDDEAMFFAPTVLGLARLRHWVYLLCFSAGISQMTQACSGTQSTWPESSFST

SEQ ID NO: 10340 - protein, 150 aa, Homo Sapiens
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLKDRANSRL

SEQ ID NO: 10341 - protein, 188 aa, Homo Sapiens
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRALHSEGKLPKESCPQPSRGSGWG

SEQ ID NO: 10342 - protein, 252 aa, Homo Sapiens
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRALHSEGKLPKGCSVLTLQSVNVLRKYISLLDLPLSLLHTQDVLFVLNSKEVAQAKKAMSCHRSQLLWFRRLYIIFSRYMRINSLSFL

SEQ ID NO: 10343 - protein, 244 aa, Homo Sapiens
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRVLCAHASVCECAAQVHLPSGSALVSASYAGCPLRAQQQRSGTGQESHVLPPQPAPLVPPPLHYLLPVHENQLTELPLKP

SEQ ID NO: 10344 - protein, 145 aa, Homo Sapiens
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRLSYLRLMCLSEAQGPQQHTPVSQSSDYSSLGMG

SEQ ID NO: 10345 - protein, 102 aa, Homo Sapiens
VVTFDAGGVSGHSNHIALYAAVRVLCAHASVCECAAQVHLPSGSALVSASYAGCPLRAQQQRSGTGQESHVLPPQPAPLVPPPLHYLLPVHENQLTELPLKP

SEQ ID NO: 10346 - protein, 92 aa, Homo Sapiens
  misc_feature (1)..(1): Xaa can be any naturally occurring amino acid
XCVALAVLAWGFLWVWDSSERMKSREQGGRLGAESRTLLVIAHPDDEAMFFAPTVLGLARLRHWVYLLCFSAVFRRELSEYTEGLTSEPLTA

SEQ ID NO: 10347 - protein, 580 aa, Homo Sapiens
LALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTEREGSPTPSWDCPDCGARGGVGSRRVIPISGMWIPRGQSPRPTPDRPLSPSDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 10348 - protein, 329 aa, Homo Sapiens
LRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLLPWT

SEQ ID NO: 10349 - protein, 476 aa, Homo Sapiens
MAAAMPLALLVLLLLGPGGWCLAEPPRDSLREELVITPLPSGDVAATFQFRTRWDSELQREGDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 10350 - protein, 275 aa, Homo Sapiens
MAAAMPLALLVLLLLGPGGWCLAEPPRDSLREELVITPLPSGDVAATFQFRTRWDSELQREGDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENGYIHYQPAQDRLQPHLLEMLIQLPANSVTKVSI

SEQ ID NO: 10351 - protein, 101 aa, Homo Sapiens
MAAAMPLALLVLLLLGPGGWCLAEPPRDSLREELVITPLPSGDVAATFQFRTRWDSELQREGDTDHYFLRYAVLPREVVCTENLTPWKKLLPCSSKASLCC

SEQ ID NO: 10352 - protein, 384 aa, Homo Sapiens
MAAAMPLALLVLLLLGPGGWCLAEPPRDSLREELVITPLPSGDVAATFQFRTRWDSELQREGDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 10353 - protein, 441 aa, Homo Sapiens
MAAAMPLALLVLLLLGPGGWCLAEPPRDSLREELVITPLPSGDVAATFQFRTRWDSELQREGGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 10354 - protein, 96 aa, Homo Sapiens
MAAAMPLALLVLLLLGPGGWCLAEPPRDSLREELVITPLPSGDVAATFQFRTRWDSELQREGGRPLCAAEGRSLVPHQLPLPGSAYPPCLQKCTLY

SEQ ID NO: 10355 - protein, 522 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 10356 - protein, 314 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTA

SEQ ID NO: 10357 - protein, 240 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRHLLGAEADPVSCI

SEQ ID NO: 10358 - protein, 578 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 10359 - protein, 511 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENGYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 10360 - protein, 331 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKALRSVSQTGPSSGCSPEPSRSPAPWLQRAESMWTSPPTTSPAFVSPGQRDIRGAPTPDHYISGRHPRHSEDLCHL

SEQ ID NO: 10361 - protein, 300 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQPCLCVPRTTRH

SEQ ID NO: 10362 - protein, 505 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLEPVTCAALRC

SEQ ID NO: 10363 - protein, 499 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLLPWT

SEQ ID NO: 10364 - protein, 499 aa, Homo Sapiens; identical to SEQ ID NO: 10363

SEQ ID NO: 10365 - protein, 300 aa, Homo Sapiens; identical to SEQ ID NO: 10361

SEQ ID NO: 10366 - protein, 429 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLLHPLPACPGPAATPPPGDADSAAGQLSHQGFHPV

SEQ ID NO: 10367 - protein, 432 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENGYIHYQPAQDRLQPHLLEMLIQLPANSVTKVSIQFERALLKWTEYTPDPNHGFYVSPSVLSALVPSMVAAKPVDWEESPLFNSLLPWT

SEQ ID NO: 10368 - protein, 495 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSL

SEQ ID NO: 10369 - protein, 232 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRVSHGE

SEQ ID NO: 10370 - protein, 203 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKASLCC

SEQ ID NO: 10371 - protein, 242 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKGFSYLFPSPPGRPLCAAEGRSLVPHQLPLPGSAYPPCLQKCTLY

SEQ ID NO: 10372 - protein, 355 aa, Homo Sapiens [sequence omitted]

SEQ ID NO: 10373 - protein, 198 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANGRPLCAAEGRSLVPHQLPLPGSAYPPCLQKCTLY

SEQ ID NO: 10374 - protein, 140 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTEFSSQLWTLKEGAEVAPGQ

SEQ ID NO: 10375 - protein, 140 aa, Homo Sapiens; identical to SEQ ID NO: 10374

SEQ ID NO: 10376 - protein, 140 aa, Homo Sapiens; identical to SEQ ID NO: 10374

SEQ ID NO: 10377 - protein, 140 aa, Homo Sapiens; identical to SEQ ID NO: 10374

SEQ ID NO: 10378 - protein, 123 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTEH

SEQ ID NO: 10379 - protein, 123 aa, Homo Sapiens; identical to SEQ ID NO: 10378

SEQ ID NO: 10380 - protein, 123 aa, Homo Sapiens; identical to SEQ ID NO: 10378

SEQ ID NO: 10381 - protein, 183 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTELVPLPDVLPNPHGALPPGFREPSLCGHHHLQPGQRDIRGAPTPDHYISGRHPRHSEDLCHL

SEQ ID NO: 10382 - protein, 316 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTEPLSPSDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLH

SEQ ID NO: 10383 - protein, 128 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTEQASLCC

SEQ ID NO: 10384 - protein, 116 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGLAASCGL

SEQ ID NO: 10385 - protein, 393 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSVWINLGRSSVMSSQGSSAPLSTSSTPPTQSLPLPPSNPWVWPMAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVT

SEQ ID NO: 10386 - protein, 191 aa, Homo Sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSVWINLGRSSVMSSQGSSAPLSTSSTPPTQSLPLPPSNPWVWPMTLTTTFCAMLCCRGRWSAPKTSPPGRSSCPVVPRQASLCC

SEQ ID NO: 10387 - protein, 318 aa, Homo Sapiens
MAAAMPLALLVLLLLGPGGWCLAEPPRDSLREELVITPLPSGDVAATFQFRTRWDSELQREGVWINLGRSSVMSSQGSSAPLSTSSTPPTQSLPLPPSNPWVWPMAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKP

SEQ ID NO: 10388 - protein, 171 aa, Homo Sapiens
MAAAMPLALLVLLLLGPGGWCLAEPPRDSLREELVITPLPSGDVAATFQFRTRWDSELQREGVWINLGRSSVMSSQGSSAPLSTSSTPPTQSLPLPPSNPWVWPMTLTTTFCAMLCCRGRWSAPKTSPPGRSSCPVVPRPLCAAEGRSLVPHQLPLPGSAYPPCLQKCTLY

SEQ ID NO: 10389 - protein, 145 aa, Homo Sapiens
MAAAMPLALLVLLLLGPGGWCLAEPPRDSLREELVITPLPSGDVAATFQFRTRWDSELQREGVWINLGRSSVMSSQGSSAPLSTSSTPPTQSLPLPPSNPWVWPMTLTTTFCAMLCCRGRWSAPKTSPPGRSSCPVVPRQASLCC

SEQ ID NO: 10390 - protein, 145 aa, Homo Sapiens; identical to SEQ ID NO: 10389

SEQ ID NO: 10391 - protein, 18 aa, Homo Sapiens
RWDSELQREGGLAASCGL

SEQ ID NO: 10392 - protein, 77 aa, Homo Sapiens
SHYRLFPKALGQLISKYSLRELHLSFTQGFWRTRYWGPPFLQAPSGAELWVWFQDTVTEFSSQLWTLKEGAEVAPGQ

SEQ ID NO: 10393 - protein, 61 aa, Homo Sapiens
  misc_feature (1)..(1): Xaa can be any naturally occurring amino acid
XLIQLPANSVTKVSIQFERALLKWTEYTPDPNHGFYVRWEHGPSLCFSVAHLSSAPLCPAW

SEQ ID NO: 10394 - protein, 78 aa, Homo Sapiens
  misc_feature (1)..(1): Xaa can be any naturally occurring amino acid
XLQPHLLEMLIQLPANSVTKVSIQFERALLKWTEYTPDPNHGFYVSPSVLSALVPSMVAAKPVDWEESPLFNSLLPWT

SEQ ID NO: 10395 - protein, 532 aa, Homo Sapiens
  misc_feature (1)..(1): Xaa can be any naturally occurring amino acid
XQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSEDLSPEPGPQPALSCPLQVPQTLISQGYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 10396 - protein, 12 aa, Homo Sapiens
  misc_feature (1)..(1): Xaa can be any naturally occurring amino acid
XWVWFQDTVTEH

SEQ ID NO: 10397 - protein, 128 aa, Homo Sapiens
  misc_feature (1)..(1): Xaa can be any naturally occurring amino acid
XYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSEDLSPEPGPQPALSCPLQVPQTLISQGSS

SEQ ID NO: 10398 - protein, 136 aa, Homo Sapiens
  misc_feature (1)..(1): Xaa can be any naturally occurring amino acid
XYQPAQDRLQPHLLEMLIQLPANSVTKVSIQFERALLKWTEYTPDPNHGFYVRFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 10399 - protein, 144 aa, Homo Sapiens
  misc_feature (1)..(1): Xaa can be any naturally occurring amino acid
XYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLLPWT

SEQ ID NO: 10400 - protein, 213 aa, Homo Sapiens
YNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLLPWT

SEQ ID NO: 10401 - protein, 579 aa, Homo Sapiens
MQICGSSVASVAAGTSFQVLGPVCWQQLDLKMAVRVLWGGLSLLRVLWCLLPQTGYVHPDEFFQSPEVMAEDILGVQAARPWEFYPSSSCRSVLFPLLISGSTFWLLRLWEELGPWPGLVSGYALLVGPRLLLTALSFALDGAVYHLAPPMGADRWNALALLSGSYVTLVFYTRTFSNTIEGLLFTWLLVLVSSHVTWGPTRKEPAPGPRWRSWLLGGIVAAGFFNRPTFLAFAVVPLYLWGTRGATNPGLKSLTREALVLLPGAALTAAVFVATDSWYFSSPATSRNLVLTPVNFLHYNLNPQNLARHGTHARLTHLAVNGFLLFGVLHAQALQAAWQRLQVGLQASAQMGLLRALGARSLLSSPRSYLLLLYFMPLALLSAFSHQEARFLIPLLVPLVLLCSPQTQPVPWKGTVVLFNALGALLFGCLHQGGLVPGLEYLEQVVHAPVLPSTPTHYTLLFTHTYMPPRHLLHLPGLGAPVEVVDMGGTEDWALCQTLKSFTRQPACQVAGGPWLCRLFVVTPGTTRRAVEKCSFPFKNETLLFPHLTLEDPPALSSLLSGAWRDHLSLHIVELGEET

SEQ ID NO: 10402 - protein, 92 aa, Homo Sapiens
MQICGSSVASVAAGTSFQVLGPVCWQQLDLKMAVRVLWGGLSLLRVLWCLLPQTGYVHPDEFFQSPEVMAGPSPTPLRDSSSRGCWCWYPPM

SEQ ID NO: 10403 - protein, 49 aa, Homo Sapiens
  misc_feature (1)..(1): Xaa can be any naturally occurring amino acid
XRVLWGGLSLLRVLWCLLPQTGYVHPDEFFQSPEVMAGSGRSWGRGLAW

SEQ ID NO: 10404 - protein, 805 aa, Homo Sapiens
MAASGVPRGCDILIVYSPDAEEWCQYLQTLFLSSRQVRSQKILTHRLGPEASFSAEDLSLFLSTRCVVVLLSAELVQHFHKPALLPLLQRAFHPPHRVVRLLCGVRDSEEFLDFFPDWAHWQELTCDDEPETYVAAVKKAISEDSGCDSVTDTEPEDEKVVSYSKQQNLPTVTSPGNLMVVQPDRIRCGAETTVYVIVRCKLDDRVATEAEFSPEDSPSVRMEAKVENEYTISVKAPNLSSGNVSLKIYSGDLVVCETVISYYTDMEEIGNLLSNAANPVEFMCQAFKIVPYNTETLDKLLTESLKNNIPASGLHLFGINQLEEEDMMTNQRDEELPTLLHFAAKYGLKNLTALLLTCPGALQAYSVANKHGHYPNTIAEKHGFRDLRQFIDEYVETVDMLKSHIKEELMHGEEADAVYESMAHLSTDLLMKCSLNPGCDEDLYESMAAFVPAATEDLYVEMLQASTSNPIPGDGFSRATKDSMIRKFLEGNSMGMTNLERDQCHLGQEEDVYHTVDDDEAFSVDLASRPPVPVPRPETTAPGAHQLPDNEPYIFKVFAEKSQERPGNFYVSSESIRKGPPVRPWRDRPQSSIYDPFAGMKTPGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEDNEVPEVTRSRSPGPPQVDGTPTMSLERPPRVPPRAASQRPPTRETFHPPPPVPPRGR

SEQ ID NO: 10405 - protein, 404 aa, Homo Sapiens
MRFFTSVACYGSCLFASELLIRCKDWLKGRPALFTALLACVLYLCEWTGAKHVPGSSYVEMLQASTSNPIPGDGFSRATKDSMIRKFLEGNSMGMTNLERDQCHLGQEEDVYHTVDDDEAFSVDLASRPPVPVPRPETTAPGAHQLPDNEPYIFKVFAEKSQERPGNFYVSSESIRKGPPVRPWRDRPQSSIYDPFAGMKTPGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEDNEVPEVTRSRSPGPPQVDGTPTMSLERPPRVPPRAASQRPPTRETFHPPPPVPPRGR

SEQ ID NO: 10406 - protein, 627 aa, Homo Sapiens
MVVQPDRIRCGAETTVYVIVRCKLDDRVATEAEFSPEDSPSVRMEAKVENEYTISVKAPNLSSGNVSLKIYSGDLVVCETVISYYTDMEEIGNLLSNAANPVEFMCQAFKIVPYNTETLDKLLTESLKNNIPASGLHLFGINQLEEEDMMTNQRDEELPTLLHFAAKYGLKNLTALLLTCPGALQAYSVANKHGHYPNTIAEKHGFRDLRQFIDEYVETVDMLKSHIKEELMHGEEADAVYESMAHLSTDLLMKCSLNPGCDEDLYESMAAFVPAATEDLYVEMLQASTSNPIPGDGFSRATKDSMIRKFLEGNSMGMTNLERDQCHLGQEEDVYHTVDDDEAFSVDLASRPPVPVPRPETTAPGAHQLPDNEPYIFKVFAEKSQERPGNFYVSSESIRKGPPVRPWRDRPQSSIYDPFAGMKTPGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEDNEVPEVTRSRSPGPPQVDGTPTMSLERPPRVPPRAASQRPPTRETFHPPPPVPPRGR

SEQ ID NO: 10407 - protein, 173 aa, Homo Sapiens
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGGRI

SEQ ID NO: 10408 - protein, 263 aa, Homo Sapiens
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGYVLGITMMVIIIAIGAGIILGYSYKRGKDLKEQHDQKVCEREMQRITLPLSAFTNPTCEIVDEKTVVVHTSQTPVDPQEGTTPLMGQAGTPGA

SEQ ID NO: 10409 - protein, 234 aa, Homo Sapiens
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGYVLGITMMVIIIAIGAGIILGYSYKRSVASLLGPLRRRGGRYTKSNFVAFLPKRKQDVENQLKM

SEQ ID NO: 10410 - protein, 145 aa, Homo Sapiens [sequence omitted]

SEQ ID NO: 10411 - protein, 303 aa, Homo Sapiens
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQAVTTTTQRPSSMTTTWRLSSTTTTTGLRVTQGKRRSDSWHISLETAVGVAVAVTVLGIMILGLICLLRWRRRKGQQRTKATTPAREPFQNTEEPYENIRNEGQNTDPKLNPKDDGIVYASLALSSSTSPRAPPSHRPLKSPQNETLYSVLKA

SEQ ID NO: 10412 - protein, 175 aa, Homo Sapiens
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQGNPSKTQRSHMRISGMKDKIQIPS

SEQ ID NO: 10413 - protein, 166 aa, Homo Sapiens
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQGQQRTKATTPAREPF

SEQ ID NO: 10414 - protein, 230 aa, Homo Sapiens
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQGQQRTKATTPAREPFQNTEEPYENIRNEGQNTDPKLNPKDDGIVYASLALSSSTSPRAPPSHRPLKSPQNETLYSVLKA

SEQ ID NO: 10415 - protein, 226 aa, Homo Sapiens
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQGQQRTKATTPAREPFQNTEEPYENIRNEGQNTDPKLNPKLHLTQSTSQPPSPQEPPERDPVLCLKGLTNGQPSQD

SEQ ID NO: 10416 - protein, 108 aa, Homo Sapiens
MGRASYGGSPVGHQSSSDHPRAKTCRSPVRDGPRTLCGVPTVALSLHFLREASSGSRTCGRRTSLCTSAKSSWTYRSGRLSWQSIKGTHLTITQALRQPLHRAPLLPG

SEQ ID NO: 10417 - protein, 271 aa, Homo Sapiens
MGRASYGGSPVGHQSSSDHPRAKTCRSPVRDGPRTLCGVPTVALSLHFLREASSGSRTCGRRTSLCTSAKSSWTYRSGRLSWQSIKGTHLTITQALRQPLHRAPLLPGQLCWSPRPLEKNKAMGRPLLLPLLLLLQPPAFLQPGLCEPALSELDRGSGERLPQDLKPAEGGPVCVFLPSRAGHPEIREAAVAVHQGDQTHHHPGCHNHHHLEAQQHNHHSRPQGHRKQRALRIMAPKSGHCHQGCIGCRCAQNCHFGTAVPPPPVVEEKER

SEQ ID NO: 10418 - protein, 46 aa, Homo Sapiens
MGRPLLLPLLLLLQPPAFLQPEGQESGFLRISNLRKEDQSVYFCRV

SEQ ID NO: 10419 - protein, 121 aa, Homo Sapiens
MGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQS

SEQ ID NO: 10420 - protein, 127 aa, Homo Sapiens
MGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQSVYFCRV

SEQ ID NO: 10421 - protein, 127 aa, Homo Sapiens; identical to SEQ ID NO: 10420

SEQ ID NO: 10422 - protein, 127 aa, Homo Sapiens; identical to SEQ ID NO: 10420

SEQ ID NO: 10423 - protein, 127 aa, Homo Sapiens; identical to SEQ ID NO: 10420

SEQ ID NO: 10424 - protein, 138 aa, Homo Sapiens
MGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQSVYFCRVELDTRRSGRQQ

SEQ ID NO: 10425 - protein, 227 aa, Homo Sapiens
MGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQSVYFCRVELDTRRSGRQQLQSIKGTKLTITQAVTTTTTWRPSSTTTIAGLRVTESKGHSESWHLSLDTAIRVALAVAVLKTVILGLLCLLLLWWRRRKGSRAPSSDF

SEQ ID NO: 10426 - protein, 227 aa, Homo Sapiens; identical to SEQ ID NO: 10425

SEQ ID NO: 10427 - protein, 60 aa, Homo Sapiens
MGRPLLLPLLLLLQPPAFLQPGLCEPALSELDRGSGERLPQDLKPAEGGPVCVFLPSRAG

SEQ ID NO: 10428 - protein, 116 aa, Homo Sapiens
MGPKDHMVTSSFCCQSDGCNSAFLSVPLTNLTENGLMCPACTASFRDKCMGPMTHCTGKENHCVSLSGHVQAGIFKPRFAMRGCATESMCFTKPGAEVPTGTNVLFLHHIECTHSP

SEQ ID NO: 10429 - protein, 116 aa, Homo Sapiens; identical to SEQ ID NO: 10428

SEQ ID NO: 10430 - protein, 116 aa, Homo Sapiens; identical to SEQ ID NO: 10428

SEQ ID NO: 10431 - protein, 204 aa, Homo Sapiens
MRLSRRPETFLLAFVLLCTLLGLGCPLHCEICTAAGSRCHGQMKTCSSDKDTCVLLVGKATSKGKELVHTYKGCIRSQDCYSGVISTTMGPKDHMVTSSFCCQSDGCNSAFLSVPLTNLTENGLMCPACTASFRDKCMGPMTHCTGKENHCVSLSGHVQAGIFKPRFAMRGCATESMCFTKPGAEVPTGTNVLFLHHIECTHSP

SEQ ID NO: 10432 - protein, 228 aa, Homo Sapiens
MWVQTHPSSASYKSWGPGTADTHTMRLSRRPETFLLAFVLLCTLLGLGCPLHCEICTAAGSRCHGQMKTCSSDKDTCVLLVGKATSKGKELVHTYKGCIRSQDCYSGVISTTMGPKDHMVTSSFCCQSDGCNSAFLSVPLTNLTENGLMCPACTASFRDKCMGPMTHCTGKENHCVSLSGHVQAGIFKPRFAMRGCATESMCFTKPGAEVPTGTNVLFLHHIECTHSP

SEQ ID NO: 10433 - protein, 146 aa, Homo Sapiens
MRLLQLLFRASPATLLLVLCLQLGANKAQDNTRKIIIKNFDIPKSVRPNDEVTAVLAVQTELKECMVVKTYLISSIPLQGAFNYKYTACLCDDNPKTFYWDFYTNRTVQIAAVVDVIRELGICPDDAAVIPIKNNRFYTIEILKVE

SEQ ID NO: 10434 - protein, 118 aa, Homo Sapiens
MERGVKNKQDFMDLSICTREKLAHVRNCKTGSSGIPVKLVTNLFNLDFPQDWQLYQYHVTYIPDLASRRLRIALLYSHSELSNKAKAFDGAILFLSQKLEEKVTELSSETQRGETIKM

SEQ ID NO: 10435 - protein, 453 aa, Homo Sapiens
MERGVKNKQDFMDLSICTREKLAHVRNCKTGSSGIPVKLVTNLFNLDFPQDWQLYQYHVTYIPDLASRRLRIALLYSHSELSNKAKAFDGAILFLSQKLEEKVTELSSETQRGETIKMTITLKRELPSSSPVCIQVFNIIFRKILKKLSMYQIGRNFYNPSEPMEIPQHKLSLWPGFAISVSYFERKLLFSADVSYKVLRNETVLEFMTALCQRTGLSCFTQTCEKQLIGLIVLTRYNNRTYSIDDIDWSVKPTHTFQKRDGTEITYVDYYKQQYDITVSDLNQPMLVSLLKKKRNDNSEAQLAHLIPELCFLTGLTDQATSDFQLMKAVAEKTRLSPSGRQQRLARLVDNIQRNTNARFELETWGLHFGSQISLTGRIVPSEKILMQDHICQPVSAADWSKDIRTCKILNAQSLNTWLILCSDRTEYVAESFLNCLRRVAGSMGFNVDYPKM

SEQ ID NO: 10436 - protein, 203 aa, Homo Sapiens
MGMLFFVGIRKVILFLLTPNSAGALNKWYKYNHDLPARIIVYRAGVGDGQLKTLIEYEVPQLLSSVAESSSNTSSRLSVIVVRKKCMPRFFTEMNRTVQNPPLGTVVDSEATRNEWYDFYLISQVACRGTVSPTYYNVIYDDNGLKPDHMQRLTFKLCHLYYNWPGIVSVPAPCQYAHKLTFLVAQSIHKEPSLELANHLFYL

SEQ ID NO: 10437 - protein, 495 aa, Homo Sapiens
MGPRSVDLSNNEASSSNGFLGTSRISTNDKYGISSGDAGSTFMERGVKNKQDFMDLSICTREKLAHVRNCKTGSSGIPVKLVTNLFNLDFPQDWQLYQYHVTYIPDLASRRLRIALLYSHSELSNKAKAFDGAILFLSQKLEEKVTELSSETQRGETIKMTITLKRELPSSSPVCIQVFNIIFRKILKKLSMYQIGRNFYNPSEPMEIPQHKLSLWPGFAISVSYFERKLLFSADVSYKVLRNETVLEFMTALCQRTGLSCFTQTCEKQLIGLIVLTRYNNRTYSIDDIDWSVKPTHTFQKRDGTEITYVDYYKQQYDITVSDLNQPMLVSLLKKKRNDNSEAQLAHLIPELCFLTGLTDQATSDFQLMKAVAEKTRLSPSGRQQRLARLVDNIQRNTNARFELETWGLHFGSQISLTGRIVPSEKILMQDHICQPVSAADWSKDIRTCKILNAQSLNTWLILCSDRTEYVAESFLNCLRRVAGSMGFNVDYPKM

SEQ ID NO: 10438 - protein, 852 aa, Homo Sapiens
MSGRARVKARGIARSPSATEVGRIQASPLPRSVDLSNNEASSSNGFLGTSRISTNDKYGISSGDAGSTFMERGVKNKQDFMDLSICTREKLAHVRNCKTGSSGIPVKLVTNLFNLDFPQDWQLYQYHVTYIPDLASRRLRIALLYSHSELSNKAKAFDGAILFLSQKLEEKVTELSSETQRGETIKMTITLKRELPSSSPVCIQVFNIIFRKILKKLSMYQIGRNFYNPSEPMEIPQHKLSLWPGFAISVSYFERKLLFSADVSYKVLRNETVLEFMTALCQRTGLSCFTQTCEKQLIGLIVLTRYNNRTYSIDDIDWSVKPTHTFQKRDGTEITYVDYYKQQYDITVSDLNQPMLVSLLKKKRNDNSEAQLAHLIPELCFLTGLTDQATSDFQLMKAVAEKTRLSPSGRQQRLARLVDNIQRNTNARFELETWGLHFGSQISLTGRIVPSEKILMQDHICQPVSAADWSKDIRTCKILNAQSLNTWLILCSDRTEYVAESFLNCLRRVAGSMGFNVDYPKIIKVQENPAAFVRAIQQYVDPDVQLVMCILPSNQKTYYDSIKKYLSSDCPVPSQCVLARTLNKQGMMMSIATKIAMQMTCKLGGELWAVEIPLKSLMVVGIDVCKDALSKDVMVVGCVASVNPRITRWFSRCILQRTMTDVADCLKVFMTGALNKWYKYNHDLPARIIVYRAGVGDGQLKTLIEYEVPQLLSSVAESSSNTSSRLSVIVVRKKCMPRFFTEMNRTVQNPPLGTVVDSEATRNEWYDFYLISQVACRGTVSPTYYNVIYDDNGLKPDHMQRLTFKLCHLYYNWPGIVSVPAPCQYAHKLTFLVAQSIHKEPSLELANHLFYL

SEQ ID NO: 10439 - protein, 181 aa, Homo Sapiens
MRRRRAAVAAGFCASFLLGSVLNVLFAPGSEPPRPGQSPEPSPAPGPGRRGGRGELARQIRARYEEAGPRLPAQAPPARARAWAAPRFATCPARSTWAQATPRPCTGSACPAVPRWRSRRWTLAATIWAAACASSGYGGAAIGWRPTSCLRRWCCWSGCGTPTCCSSMATATRTARTSQTP

SEQ ID NO: 10440 - protein, 493 aa, Homo Sapiens
MRRRRAAVAAGFCASFLLGSVLNVLFAPGSEPPRPGQSPEPSPAPGPGRRGGRGELARQIRARYEEVQRYSRGGPGPGAGRPERRRLMDLAPGGPGLPRPRPPWARPLSDGAPGWPPAPGPGSPGPGPRLGCAALRNVSGAQYMGSGYTKAVYRVRLPGGAAVALKAVDFSGHDLGSCVREFGVRRGCYRLAAHKLLKEMVLLERLRHPNVLQLYGYCYQDSEDIPDTLTTITELGAPVEMIQLLQTSWEDRFRICLSLGRLLHHLAHSPLGSVTLLDFRPRQFVLVDGELKVTDLDDARVEETPCAGSTDCILEFPARNFTLPCSAQGWCEGMNEKRNLYNAYRFFFTYLLPHSAPPSLRPLLDSIVNATGELAWGVDETLAQLEKVLHLYRSGQYLQNSTASSSTEYQCIPDSTIPQEDYRCWPSYHHGSCLLSVFNLAEAVDVCESHAQCRAFVVTNQTTWTGRQLVFFKTGWSQVVPDPNKTTYVKASG

SEQ ID NO: 10441 - protein, 4074 aa, Homo Sapiens
MTAWLISLMSIEVLLLAVRHLSLHIEPEEGSLAGGTWITVIFDGLELGVLYPNNGSQLEIHLVNVNMVVPALRSVPCDVFPVFLDLPVVTCRTRSVLSEAHEGLYFLEAYFGGQLVSSPNPGPRDSCTFKFSKAQTPIVHQVYPPSGVPGKLIHVYGWIITGRLETFDFDAEYIDSPVILEAQGDKWVTPCSLINRQMGSCYPIQEDHGLGTLQCHVEGDYIGSQNVSFSVFNKGKSMVHKKAWLISAKQDLFLYQTHSEILSVFPETGSLGGRTNITITGDFFDNSAQVTIAGIPCDIRHVSPRKIECTTRAPGKDVRLTTPQPGNRGLLFEVGDAVEGLELTEATPGYRWQIVPNASSPFGFWSQEGQPFRARLSGFFVAPETNNYTFWIQADSQASLHFSWSEEPRTKVKVASISVGTADWFDSWEQNRDEGTWQQKTPKLELLGGAMYYLEAEHHGIAPSRGMRIGVQIHNTWLNPDVVTTYLREKHQIRVRAQRLPEVQVLNVSGRGNFFLTWDNVSSQPIPANATAHLIQTTIEELLAVKCKLEPLWSNILLRLGFERGPEVSNSDGDLTSGTEPFCGRFSLRQPRHLVLTPPAAQKGYRLDQYTHLCLAYKGHMNKILKMIVSFTIGFQNMVKNTTCDWSLTRTSPESWQFDCTDLWETCVRCFGDLQPPPANSPVLVHQINLLPLAQETGLFYVDEIIIADTNVTVSQADSGTARPGGNLVESVSVVGSPPVYSVTSWLAGCGTELPLITARSVPTEGTEEGSGLVLVTTQRRQRTSPPLGGHFRIQLPNTVISDVPVQISAHHLHQLLQNNADDFTSRYLNASDFTVKEDLYTCYEHVWTLSWSTQIGDLPNFIRVSDENLTGVNPAAATRVVYDGGVFLGPIFGDMLATANQHTQVVVRVNDVPAHCPGSCSFQYLQGSTPCVHSVWYSIDGDINLMIYITGTGFSGDSQFLQVTVNKTSCKVIFSNQTNVVCQTDLLPVGMHRILMLVRPSGLAISATGEDLFLNVKPRLDMVEPSRAADIGGLWATIRGSSLEGVSLILFGSYSCAINVATSNSSRIQCKVPPRGKDGRIVNVTVIRGDYSAVLPRAFTYVSSLNPVIVTLSRNISNIAGGETLVIGVARLMNYTDLDVEVHVQDALAPVHTQSAWGLEVALPPLPAGLHRISVSINGVSIHSQGVDLHIQYLTEVFSIEPCCGSLLGGTILSISGIGFSRDPALVWVLVGNRSCDIVNLTEASIWCETLPAPQIPDAGAPTVPAAVEVWAGNRFFARGPSPSLVGKGFTFMYEAAATPVVTAMQGEITNSSLSLHVGGSNLSNSVILLGNLNCDVETQSFQGNVSLSGCSIPLHSLEAGIYPLQVRQKQMGFANMSVVLQQFAVMPRIMAIFPSQGSACGGTILTVRGLLLNSRRRSVRVDLSGPFTCVILSLGDHTILCQVSLEGDPLPGASFSLNVTVLVNGLTSECQGNCTLFIREEASPVMDALSTNTSGSLTTVLIRGQRLATTADEPMVFVDDQLPCNVTFFNASHVVCQTRDLAPGPHYLSVFYTRNGYACSGNVSRHFYIMPQVFHYFPKNFSLHGGSLLTIEGTGLRGQNTTSVYIDQQTCLTVNIGAELIRCIVPTGNGSVALEIEVDGLWYHIGVIGYNKAFTPELISISQSDDILTFAVAQISGAANIDIFIGMSPCVGVSGNHTVLQCVVPSLPAGEYHVRGYDCIRGWASSALVFTSRVIITAVTENFGCLGGRLVHVFGAGFSPGNVSAAVCGAPCRVLANATVSAFSCLVLPLDVSLAFLCGLKREEDSCEAARHTYVQCDLTVAMATEQLLESWPYLYICEESSQCLFVPDHWAESMFPSFSGLFISPKLERDEVLIYNSSCNITMETEAEMECETPNQPITVKITEIRKRWGQNTQGNFSLQFCRRWSRTHSWFPERLPQDGDNVTVENGQLLLLDTNTSILNLLHIKGGKLIFMAPGPIELRAHAILVSDGGELRIGSEDKPFQGRAQITLYGSSYSTPFFPYGVKFLAVRNGTLSLHGSLPEVIVTCLRATAHALDTVLALEDAVDWNPGDEVVIISGTGVKGAKPMEEIVTVETVQDTDLYLKSPLRYSHNFTENWVAGEHHILKATVALLSRSITIQGNLTNEREKLLVSCQEANAPEGNLQHCLYSMSEKMLGSRDMGARVIVQSFPEEPSQVQLKGVQFQVLGQAFHKHLSSLTLVGAMRESFIQGCTVRNSFSRGLSMCGTLGLKVDSNVFYNILGHALLVGTCTEMRYISWEAIHGRKDDWSGHGNIIRNNVIIQVSGAEGLSNPEMLTPSGIYICSPTNVIEGNRVCGAGYGYFFHLMTNQTSQAPLLSFTQNIAHSCTRYGLFVYPKFQPPWDNVTGTTLFQSFTVWESAGGAQIFRSSNLRLKNFKVYSCRDFGIDVLESDANTSVTDSLLLGHFAHKGSLCMSSGIKTPKRWELMVSNTTFVNFDLINCVAIRTCSDCSQGQGGFTVKTSQLKFTNSSNLVAFPFPHAAILEDLDGSLSGKNRSHILASMETLSASCLVNSSFGRVVHGSACGGGVLFHRMSIGLANTPEVSYDLTMTDSRNKTTTVNYVRDTLSNPRGWMALLLDQETYSLQSENLWINRSLQYSATFDNFAPGNYLLLVHTDLPPYPDILLRCGSRVGLSFPFLPSPGQNQGCDWFFNSQLRQLTYLVSGEGQVQVILRVKEGMPPTISASTSAPESALKWSLPETWQGVEEGWGGYNNTIPGPGDDVLILPNRTVLVDTDLPFFKGLYVMGTLDFPVDRSNVLSVACMVIAGGELKVGTLENPLEKEQKLLILLRASEGVFCDRMNGIHIDPGTIGVYGKVHLYSAYPKNSWTHLGADIASGNERIIVEDAVDWRPHDKIVLSSSSYEPHEAEVLTVKEVKGHHVRIYERLKHRHIGSVHVTEDGRHIRLAAEVGLLTRNIQIQPDVSCRGRLFVGSFRKSSREEFSGVLQLLNVEIQNFGSPLYSSVEFSNVSAGSWIISSTLHQSCGGGIHAAASHGVLLNDNIVFGTAGHGIDLEGQAYTVTNNLVVLMTQPAWSTIWVAGIKVNQVKDINLHGNVVAGSERLGFHIRGHKCSSCELLWSDNVAHSSLHGLHLYKESGLDNCTRISGFLAFKNFDYGAMLHVENSVEIENITLVDNTIGLLAVVYVFSAPQNSVKKVQIVLRNSVIVATSSSFDCIQDKVKPHSANLTSTDRAPSNPRGGRIGILWPVFTSEPNQWPQEPWHKVRNDHSISGIMKLQDVTFSSFVKSCYSDDLDVCILPNAENSGIMHPITAERTRMLKIKDKNKFYFPSLQPRKDLGKVVCPELDCASPRKYLFKDLDGRALGLPPPVSVFPKTEAEWTASFFNAGTFREEQKCTYQFLMQGFICKQTDQVVLILDSADAIWAIQKLYPVVSVTSGFVDVFSSVNANIPCSTSGSVSTFYSILPIRQITKVCFMDQTPQVLRFFLLGNKSTSKLLLAVFYHELQSPHVFLGESFIPPTLVQSASLLLNESIGANYFNIMDNLLYVVLQGEEPIEIRSGVSIHLALTVMVSVLEKGWEIVILERLTNFLQIGQNQIRFIHEMPGHEETLKAIADSRAKRKRNCPTVTCTSHYRRVGQRRPLMMEMNSHRASPPMTVETISKVIVIEIGDSPTVRSTGMISSLSSNKLQNLAHRVITAQQTGVLENVLNMTIGALLVTQSKGVIGYGNTSSFKTGNLIYIRPYALSILVQPSDGEVGNELPVQPQLVFLDEQNRRVESLGPPSEPWTISASLEGASDSVLKGCTQAETQDGYVSFYNLAVLISGSNWHFIFTVTSPPGVNFTARSKPFAVLPVTRKEKSTIILAASLSSVASWLALSCLVCCWLKRSKSRKTKPEEIPESQTNNQNIHIHISSKRRESQGPKKEDTVVGEDMRMKVMLGKVNQCPHQLMNGVSRRKVSRHIVREEEAAVPAPGTTGITSHGHICAPGAPAQQVYLQETGNWKEGQEQLLRYQLAGQNQLLLLCPDFRQERQQLPGQSRLSKQSGSLGLSQEKKASCGATEAFCLHSVHPETIQEQL

SEQ ID NO: 10442 - protein, 3396 aa, Homo Sapiens
MTAWLISLMSIEVLLLAVRHLSLHIEPEEGSLAGGTWITVIFDGLELGVLYPNNGSQLEIHLVNVNMVVPALRSVPCDVFPVFLDLPVVTCRTRSVLSEAHEGLYFLEAYFGGQLVSSPNPGPRDSCTFKFSKAQTPIVHQVYPPSGVPGKLIHVYGWIITGRLETFDFDAEYIDSPVILEAQGDKWVTPCSLINRQMGSCYPIQEDHGLGTLQCHVEGDYIGSQNVSFSVFNKGKSMVHKKAWLISAKQDLFLYQTHSEILSVFPETGSLGGRTNITITGDFFDNSAQVTIAGIPCDIRHVSPRKIECTTRAPGKDVRLTTPQPGNRGLLFEVGDAVEGLELTEATPGYRWQIVPNASSPFGFWSQEGQPFRARLSGFFVAPETNNYTFWIQADSQASLHFSWSEEPRTKVKVASISVGTADWFDSWEQNRDEGTWQQKTPKLELLGGAMYYLEAEHHGIAPSRGMRIGVQIHNTWLNPDVVTTYLREKHQIRVRAQRLPEVQVLNVSGRGNFFLTWDNVSSQPIPANATAHLIQTTIEELLAVKCKLEPLWSNILLRLGFERGPEVSNSDGDLTSGTEPFCGRFSLRQPRHLVLTPPAAQKGYRLDQYTHLCLAYKGHMNKILKMIVSFTIGFQNMVKNTTCDWSLTRTSPESWQFDCTDLWETCVRCFGDLQPPPANSPVLVHQINLLPLAQETGLFYVDEIIIADTNVTVSQADSGTARPGGNLVESVSVVGSPPVYSVTSWLAGCGTELPLITARSVPTEGTEEGSGLVLVTTQRRQRTSPPLGGHFRIQLPNTVISDVPVQISAHHLHQLLQNNADDFTSRYLNASDFTVKEDLYTCYEHVWTLSWSTQIGDLPNFIRVSDENLTGVNPAAATRVVYDGGVFLGPIFGDMLATANQHTQVVVRVNDVPAHCPGSCSFQYLQGSTPCVHSVWYSIDGDINLMIYITGTGFSGDSQFLQVTVNKTSCKVIFSNQTNVVCQTDLLPVGMHRILMLVRPSGLAISATGEDLFLNVKPRLDMVEPSRAADIGGLWATIRGSSLEGVSLILFGSYSCAINVATSNSSRIQCKVPPRGKDGRIVNVTVIRGDYSAVLPRAFTYVSSLNPVIVTLSRNISNIAGGETLVIGVARLMNYTDLDVEVHVQDALAPVHTQSAWGLEVALPPLPAGLHRISVSINGVSIHSQGVDLHIQYLTEVFSIEPCCGSLLGGTILSISGIGFSRDPALVWVLVGNRSCDIVNLTEASIWCETLPAPQIPDAGAPTVPAAVEVWAGNRFFARGPSPSLVGKGFTFMYEAAATPVVTAMQGEITNSSLSLHVGGSNLSNSVILLGNLNCDVETQSFQGNVSLSGCSIPLHSLEAGIYPLQVRQKQMGFANMSVVLQQFAVMPRIMAIFPSQGSACGGTILTVRGLLLNSRRRSVRVDLSGPFTCVILSLGDHTILCQVSLEGDPLPGASFSLNVTVLVNGLTSECQGNCTLFIREEASPVMDALSTNTSGSLTTVLIRGQRLATTADEPMVFVDDQLPCNVTFFNASHVVCQTRDLAPGPHYLSVFYTRNGYACSGNVSRHFYIMPQVFHYFPKNFSLHGGSLLTIEGTGLRGQNTTSVYIDQQTCLTVNIGAELIRCIVPTGNGSVALEIEVDGLWYHIGVIGYNKAFTPELISISQSDDILTFAVAQISGAANIDIFIGMSPCVGVSGNHTVLQCVVPSLPAGEYHVRGYDCIRGWASSALVFTSRVIITAVTENFGCLGGRLVHVFGAGFSPGNVSAAVCGAPCRVLANATVSAFSCLVLPLDVSLAFLCGLKREEDSCEAARHTYVQCDLTVAMATEQLLESWPYLYICEESSQCLFVPDHWAESMFPSFSGLFISPKLERDEVLIYNSSCNITMETEAEMECETPNQPITVKITEIRKRWGQNTQGNFSLQFCRRWSRTHSWFPERLPQDGDNVTVENGQLLLLDTNTSILNLLHIKGGKLIFMAPGPIELRAHAILVSDGGELRIGSEDKPFQGRAQITLYGSSYSTPFFPYGVKFLAVRNGTLSLHGSLPEVIVTCLRATAHALDTVLALEDAVDWNPGDEVVIISGTGVKGAKPMEEIVTVETVQDTDLYLKSPLRYSHNFTENWVAGEHHILKATVALLSRSITIQGNLTNEREKLLVSCQEANAPEGNLQHCLYSMSEKMLGSRDMGARVIVQSFPEEPSQVQLKGVQFQVLGQAFHKHLSSLTLVGAMRESFIQGCTVRNSFSRGLSMCGTLGLKVDSNVFYNILGHALLVGTCTEMRYISWEAIHGRKDDWSGHGNIIRNNVIIQVSGAEGLSNPEMLTPSGIYICSPTNVIEGNRVCGAGYGYFFHLMTNQTSQAPLLSFTQNIAHSCTRYGLFVYPKFQPPWDNVTGTTLFQSFTVWESAGGAQIFRSSNLRLKNFKVYSCRDFGIDVLESDANTSVTDSLLLGHFAHKGSLCMSSGIKTPKRWELMVSNTTFVNFDLINCVAIRTCSDCSQGQGGFTVKTSQLKFTNSSNLVAFPFPHAAILEDLDGSLSGKNRSHILASMETLSASCLVNSSFGRVVHGSACGGGVLFHRMSIGLANTPEVSYDLTMTDSRNKTTTVNYVRDTLSNPRGWMALLLDQETYSLQSENLWINRSLQYSATFDNFAPGNYLLLVHTDLPPYPDILLRCGSRVGLSFPFLPSPGQNQGCDWFFNSQLRQLTYLVSGEGQVQVILRVKEGMPPTISASTSAPESALKWSLPETWQGVEEGWGGYNNTIPGPGDDVLILPNRTVLVDTDLPFFKGLYVMGTLDFPVDRSNVLSVACMVIAGGELKVGTLENPLEKEQKLLILLRASEGVFCDRMNGIHIDPGTIGVYGKVHLYSAYPKNSWTHLGADIASGNERIIVEDAVDWRPHDKIVLSSSSYEPHEAEVLTVKEVKGHHVRIYERLKHRHIGSVHVTEDGRHIRLAAEVGLLTRNIQIQPDVSCRGRLFVGSFRKSSREEFSGVLQLLNVEIQNFGSPLYSSVEFSNVSAGSWIISSTLHQSCGGGIHAAASHGVLLNDNIVFGTAGHGIDLEGQAYTVTNNLVVLMTQPAWSTIWVAGIKVNQVKDINLHGNVVAGSERLGFHIRGHKCSSCELLWSDNVAHSSLHGLHLYKESGLDNCTRISGFLAFKNFDYGAMLHVENSVEIENITLVDNTIGLLAVVYVFSAPQNSVKKVQIVLRNSVIVATSSSFDCIQDKVKPHSANLTSTDRAPSNPRGGRIGILWPVFTSEPNQWPQEPWHKVRNDHSISGIMKLQDVTFSSFVKSCYSDDLDVCILPNAENSGIMHPITAERTRMLKIKDKNKFYFPSLQPRKDLGKVVCPELDCASPRKYLFKDLDGRALGLPPPVSVFPKTEAEWTASFFNAVTTEQALKISE

SEQ ID NO: 10443 - protein, 440 aa, Homo Sapiens
MHKSSSIWGDAPPTPQPKCADFQSANLFEGTDLKVQFLLFVPSNPSCGQLVEGSSDLQNSGFNATLGTKLIIHGFRVLGTKPSWIDTFIRTLLRATNANVIAVDWIYGSTGVYFSAVKNVIKLSLEISLFLNKLLVLGVSESSIHIIGVSLGAHVGGMVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCMHHSLVEFHLKELRNKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 10444 - protein, 456 aa, Homo Sapiens
MPPGPWESCFWVGGLILWLSVGSSGDAPPTPQPKCADFQSANLFEGTDLKVQFLLFVPSNPSCGQLVEGSSDLQNSGFNATLGTKLIIHGFRVLGTKPSWIDTFIRTLLRATNANVIAVDWIYGSTGVYFSAVKNVIKLSLEISLFLNKLLVLGVSESSIHIIGVSLGAHVGGMVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCMHHSLVEFHLKELRNKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 10445 - protein, 440 aa, Homo Sapiens
MPPGPWESCFWVGGLILWLSVGSSGDAPPTPQPKCADFQSANLFEGTDLKVQFLLFVPSNPSCGQLVEGSSDLQNSGFNATLGTKLIIHGFRVLGTKPSWIDTFIRTLLRATNANVIAVDWIYGSTGVYFSAVKNVLGVSESSIHIIGVSLGAHVGGMVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCMHHSLVEFHLKELRNKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 10446 - protein, 283 aa, Homo Sapiens
MVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCMHHSLVEFHLKELRNKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 10447 - protein, 224 aa, Homo Sapiens
NVIKLSLEISLFLNKLLVLGVSESSIHIIGVSLGAHVGGMVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCNAFQLLTVAPNHGISLKLGCW

SEQ ID NO: 10448 - protein, 165 aa, Homo Sapiens
MGPLPVCLPIMLLLLLPSLLLLLLLPGPGSGEASRILRVHRRGILELAGTVGCVGPRTPIAYMKYGCFCGLGGHGQPRDAIDWCCHGHDCCYTRAEEAGCSPKTERYSWQCVNQSVLCGPAENKCQELLCKCDQEIANCLAQTEYNLKYLFYPQFLCEPDSPKCD

SEQ ID NO: 10449 - protein, 130 aa, Homo Sapiens
MGPLPVCLPIMLLLLLPSLLLLLLLPGPGSGEASRILRVHRRGILELAGTVGCVGPRTPIAYMKYGCFCGLGGHGQPRDAIDWCCHGHDCCYTRAEEAGCSPKTERYSWQCVNQSVLCVLLCHPGWSAVV

SEQ ID NO: 10450 - protein, 70 aa, Homo Sapiens
MALLSRPALTLLLLLMAAVVRCQEQAQTTDWRATLKTIRNGVHKIDTYLNAALDLLGGEDGLCQYKCSDA

SEQ ID NO: 10451 - protein, 187 aa, Homo Sapiens
MALLSRPALTLLLLLMAAVVRCQEQAQTTDWRATLKTIRNGVHKIDTYLNAALDLLGGEDGLCQYKCSDGSKPFPRYGYKPSPPNGCGSPLFGLNIGIPSLTKCCNQHDRCYETCGKSKNDCDEEFQYCLSKICRDVQKTLGLTQHVQACETTVELLFDSVIHLGCKPYLDSQRAACRCHYEEKTDL

SEQ ID NO: 10452 - protein, 189 aa, Homo Sapiens
MALLSRPALTLLLLLMAAVVRCQEQAQTTDWRATLKTIRNGVHKIDTYLNAALDLLGGEDGLCQYKCSDGSKPFPRYGYKPSPPNGCGSPLFGVHLNIGIPSLTKCCNQHDRCYETCGKSKNDCDEEFQYCLSKICRDVQKTLGLTQHVQACETTVELLFDSVIHLGCKPYLDSQRAACRCHYEEKTDL

SEQ ID NO: 10453 - protein, 195 aa, Homo Sapiens
MKLASGFLVLWLSLGGGLAQSDTSPDTEESYSDWGLRHLRGSFESVNSYFDSFLELLGGKNGVCQYRCRYGKAPMPRPGYKPQEPNGCGSYFLGLKVPESMDLGIPAMTKCCNQLDVCYDTCGANKYRCDAKFRWCLHSICSDLKRSLGFVSKVEAACDSLVDTVFNTVWTLGCRPFMNSQRAACICAEEEKEEL

SEQ ID NO: 10454 - protein, 212 aa, Homo Sapiens
MGLHLRPYRVGLLPDGLLFLLLLLMLLADPALPAGRHPPVVLGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 10455 - protein, 318 aa, Homo Sapiens
MGLHLRPYRVGLLPDGLLFLLLLLMLLADPALPAGRHPPVVLGWFTTKHPGPPSFLMVWMYVSLALGRPSHWSSWTPAKAAWVPISTPWWRALWAGATHGVRMSEGLPMTGAEPQRQPQAWKDKYIRAFVSLGAPWGGVAKTLRVLASGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 10456 - protein, 86 aa, Homo Sapiens
MGLHLRPYRVGLLPDGLLFLLLLLMLLADPALPAGRHPPVVLVEMGFHHIGQAGLELLTASDPLTSASQSAGITGMSPCALPRSPW

SEQ ID NO: 10457 - protein, 242 aa, Homo Sapiens
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLECSGAISAHYTSASQAQALLLPQTPDNWDYRLVYNKTSRATQFPDGVDVRVPGFGKTFSLEFLDPSKSSVGSYFHTMVESLVGWGYTRGEDVRGAPYDWRRAPTAAAGLEGQVYPGLRVTGCALGGRGQDPARPGFRRQQPDPSHR

SEQ ID NO: 10458 - protein, 163 aa, Homo Sapiens
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLVYNKTSRATQFPDGVDVRVPGFGKTFSLEFLDPSKSSVDENGPYFLALREMIEEMYQLYGGPVVLVA

SEQ ID NO: 10459 - protein, 412 aa, Homo Sapiens
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLVYNKTSRATQFPDGVDVRVPGFGKTFSLEFLDPSKSSVGSYFHTMVESLVGWGYTRGEDVRGAPYDWRRAPNENGPYFLALREMIEEMYQLYGGPVVLVAHSMGNMYTLYFLQRQPQAWKDKYIRAFVSLGAPWGGVAKTLRVLASGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 10460 - protein, 236 aa, Homo Sapiens
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLVYNKTSRATQFPDGVDVRVPGFGKTFSLEFLDPSKSSVGSYFHTMVESLVGWGYTRGEDVRGAPYDWRRAPTAAAGLEGQVYPGLRVTGCALGGRGQDPARPGFRRQQPDPSHRAPEDPGAAAVSCLHQLAAALQLHMVT

SEQ ID NO: 10461 - protein, 298 aa, Homo Sapiens
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLVYNKTSRATQFPDGVDVRVPGFGKTFSLEFLDPSKSSVGSYFHTMVESLVGWGYTRGEDVRGAPYDWRRAPTQWFRLQDPSHLTPAWLWPADENGPYFLALREMIEEMYQLYGGPVVLVAHSMGNMYTLYFLQRQPQAWKDKYIRAFVSLGAPWGGVAKTLRVLASGDNNRIPVIGPLKIREQQRSAVSTSWLLPYNYTWSP

SEQ ID NO: 10462 - protein, 119 aa, Homo Sapiens
MIKCVIPGSDPFLEYNNYGCYCGLGGSGTPVDELDKCCQTHDNCYDQAKKLDSCKFLLDNPYTHTYSYSCSGSAITCSSKNKECEAFICNCDRNAAICFSKAPYNKAHKNLDTKKYCQS

SEQ ID NO: 10463 - protein, 148 aa, Homo Sapiens
MKLLVLAVLLTVAAADSGISPRAVWQFRKMIKCVIPGSDPFLEYNNYGCYCGLGGSGTPVDELDKCCQTHDNCYDQAKKLDSCKFLLDNPYTHTYSYSCSGSAITCSSKNKECEAFICNCDRNAAICFSKAPYNKAHKNLDTKKYCQS

SEQ ID NO: 10464 - protein, 70 aa, Homo Sapiens
MKLLVLAVLLTVAAADSGISPRAVWQFRKMIKCVIPGSDPFLEYNNYGCYCGLGGSGTPVDELDKQKQRV

SEQ ID NO: 10465 - protein, 144 aa, Homo Sapiens
MKTLLLLAVIMIFGLLQAHGNLVNFHRMIKLTTGKEAALSYGFYGCHCGVGGRGSPKDATDRCCVTHDCCYKRLEKRGCGTKFLSYKFSNSGSRITCAKQDSCRSQLCECDKAAATCFARNKTTYNKKYQYYSNKHCRGSTPRC

SEQ ID NO: 10466 - protein, 144 aa, Homo Sapiens; identical to SEQ ID NO: 10465

SEQ ID NO: 10467 - protein, 149 aa, Homo Sapiens
MKVIAILTLLLFCSPTHSSFWQFQRRVKHITGRSAFFSYYGYGCYCGLGDKGIPVDDTDRHSPSSPSPYEKLKEFSCQPVLNSYQFHIVNGAVVCGCTLGPGASCHCRLKACECDKQSVHCFKESLPTYEKNFKQFSSQPRCGRHKPWC

SEQ ID NO: 10468 - protein, 150 aa, Homo Sapiens
MLIATSFFLFFSSVVAAPTHSSFWQFQRRVKHITGRSAFFSYYGYGCYCGLGDKGIPVDDTDSPSSPSPYEKLKEFSCQPVLNSYQFHIVNGAVVCGCTLGPGASCHCRLKACECDKQSVHCFKESLPTYEKNFKQFSSQPRCGRHKPWC

SEQ ID NO: 10469 - protein, 62 aa, Homo Sapiens
MELALLCGLVVMAGVIPIQGGILNLNKMVKQVTGKMPILSYWPYGCHCGLGGRGQPKDATDC

SEQ ID NO: 10470 - protein, 145 aa, Homo Sapiens
MELALLCGLVVMAGVIPIQGGILNLNKMVKQVTGKMPILSYWPYGCHCGLGGRGQPKDATDWCCQTHDCCYDHLKTQGCSIYKDYYRYNFSQGNIHCSDKGSWCEQQLCACDKEVAFCLKRNLDTYQKRLRFYWRPHCRGQTPGC

SEQ ID NO: 10471 - protein, 142 aa, Homo Sapiens
MKSPHVLVFLCLLVALVTGNLVQFGVMIEKMTGKSALQYNDYGCYCGIGGSHWPVDQTDWCCHAHDCCYGRLEKLGCEPKLEKYLFSVSERGIFCAGRTTCQRLTCECDKRAALCFRRNLGTYNRKYAHYPNKLCTGPTPPC

SEQ ID NO: 10472 - protein, 509 aa, Homo Sapiens
MGVQAGLFGMLGFLGVALGGSPALRWYRTSCHLTKAVPGNPLGYLSFLAKDAQGLALIHARWDAHRRLQSCSWEDEPELTAAYGALCAHETAWGSFIHTPGPELQRALATLQSQWEACRALEESPAGARKKRAAGQSGVPGGGHQREKRGWTMPGTLWCGVGDSAGNSSELGVFQGPDLCCREHDRCPQNISPLQYNYGIRNYRFHTISHCDCDTRFQQCLQNQHDSISDIVGVAFFNVLEIPCFVLEEQEACVAWYWWGGCRMYGTVPLARLQPRTFYNASWSSRATSPTPSSRSPAPPKPRQKQHLRKGPPHQKGSKRPSKANTTALQDPMVSPRLDVAPTGLQGPQGGLKPQGARWVCRSFRRHLDQCEHQIGPREIEFQLLNSAQEPLFHCNCTRRLARFLRLHSPPEVTNMLWELLGTTCFKLAPPLDCVEGKNCSRDPRAIRVSARHLRRLQQRRHQLQDKGTDERQPWPSEPLRGPMSFYNQCLQLTQAARRPDRQQKSWSQ

SEQ ID NO: 10473 - protein, 138 aa, Homo Sapiens
MKGLLPLAWFLACSVPAVQGGLLDLKSMIEKVTGKNALTNYGFYGCYCGWGGRGTPKDGTDWCCWAHDHCYGRLEEKGCNIRTQSYKYRFAWGVVTCEPGPFCHVNLCACDRKLVYCLKRNLRSYNPQYQYFPNILCS

SEQ ID NO: 10474 - protein, 441 aa, Homo Sapiens
MVPPKLHVLFCLCGCLAVVYPFDWQYINPVAHMKSSAWVNKIQVLMAAASFGQTKIPRGNGPYSVGCTDLMFDHTNKGTFLRLYYPSQDNDRLDTLWIPNKEYFWGLSKFLGTHWLMGNILRLLFGSMTTPANWNSPLRPGEKYPLVVFSHGLGAFRTLYSAIGIDLASHGFIVAAVEHRDRSASATYYFKDQSAAEIGDKSWLYLRTLKQEEETHIRNEQVRQRAKECSQALSLILDIDHGKPVKNALDLKFDMEQLKDSIDREKIAVIGHSFGGATVIQTLSEDQRFRCGIALDAWMFPLGDEVYSRIPQPLFFINSEYFQYPANIIKMKKCYSPDKERKMITIRGSVHQNFADFTFATGKIIGHMLKLKGDIDSNVAIDLSNKASLAFLQKHLGLHKDFDQWDCLIEGDDENLIPGTNINTTNQHIMLQNSSGIEKYN

SEQ ID NO: 10475 - protein, 441 aa, Homo Sapiens; identical to SEQ ID NO: 10474

SEQ ID NO: 10476 - protein, 1463 aa, Homo Sapiens
MLLSPSLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNNETIKWFDGTPTDQSNWGIRKPDTDYFKPHHCVALRIPEGLWQLSPCQEKKGFICKMEADIHTAEALPEKGPSHSIIPLAVVLTLIVIVAICTLSFCIYKHNGGFFRRLAGFRNPYYPATNFSTVYLEENILISDLEKSDQ

SEQ ID NO: 10477 - protein, 1324 aa, Homo Sapiens
MLLSPSLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNSK

SEQ ID NO: 10478 - protein, 212 aa, Homo Sapiens
MKVFKFIGLMILLTSAFSAGSGQSPMTVLCSIDWFMVTVHPFMLNNDVCVHFHELHLGLGCPPNHVQPHAYQFTYRVTECGIRAKAVSQDMVIYSTEIHYSSKGTPSKFVIPVSCAAPQKSPWLTKPCSMRVASKSRATAQKDEKCYEVFSLSQSSQRPNCDCPPCVFSEEEHTQVPCHQAGAQEAQPLQPSHFLDISEDWSLHTDDMIGSM

SEQ ID NO: 10479 - protein, 55 aa, Homo Sapiens
MAVQRRLDVMEEMVEKTVDHLGTEVKGLLGLLEELAWNLPPGPFSPAPDLLGDGF

SEQ ID NO: 10480 - protein, 87 aa, Homo Sapiens
MRPLLCALTGLALLRAAGSLAAAEPFSPPRGDSAQSTACDRHMAVQRRLDVMEEMASEPWSWSPAVGGGAPARQRPQNQPCPLDFLP

SEQ ID NO: 10481 - protein, 97 aa, Homo Sapiens
MRPLLCALTGLALLRAAGSLAAAEPFSPPRGDSAQSTACDRHMAVQRRLDVMEEMVEKTVDHLGTEVKGLLGLLEELAWNLPPGPFSPAPDLLGDGF

SEQ ID NO: 10482 - protein, 516 aa, Homo Sapiens
MDAMKRGLCCVLLLCGAVFVSPSQEIHARFRRGARSYQGCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 10483 - protein, 436 aa, Homo Sapiens
MDAMKRGLCCVLLLCGAVFVSPSQEIHARFRRGARSYQVICRDEKTQMIYQQHQSWLRPVLRSNRVEYCWCNSGRAQCHSVPVKRNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 10484 - protein, 499 aa, Homo Sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 10485 - protein, 157 aa, Homo Sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALA

SEQ ID NO: 10486 - protein, 178 aa, Homo Sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNY

SEQ ID NO: 10487 - protein, 562 aa, Homo Sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 10488 - protein, 562 aa, Homo Sapiens; identical to SEQ ID NO: 10487

SEQ ID NO: 10489 - protein, 473 aa, Homo Sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 10490 - protein, 96 aa, Homo Sapiens
  misc_feature (1)..(1): Xaa can be any naturally occurring amino acid
XFAGKCCEIDTRATCYEDQGISYRGTWSTAESGAECTNWNSSALAQKPYSGRRPDAIRLGLGNHNYCRTPVPRHWAWANIITAGILMGMPSPGATC

SEQ ID NO: 10491 - protein, 106 aa, Homo Sapiens
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHA

SEQ ID NO: 10492 - protein, 431 aa, Homo Sapiens
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKLLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 10493 - protein, 414 aa, Homo Sapiens
MVFHLRTRYEQANCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKLLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 10494 - protein, 78 aa, Homo Sapiens
MDGAWRLASWGLRCMQCKTNGDCRVEECALGQDLCRTTIVRLWEEGEELELVEKSCTHSEKTNRTLSYRTGLKITSLT

SEQ ID NO: 10495 - protein, 152 aa, Homo Sapiens
MDTNLNGRGLETWSSWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEE

SEQ ID NO: 10496 - protein, 335 aa, Homo Sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 10497 - protein, 281 aa, Homo Sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHERSLWGSWLPCKSTTALRPPCCEEAQATHV

SEQ ID NO: 10498 - protein, 286 aa, Homo Sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPKPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 10499 - protein, 290 aa, Homo Sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEVLELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 10500 - protein, 46 aa, Homo Sapiens
MGHPPLLPLLLLLHTCVPAWATARDSISKKKKRKKKERRNLRRYNL

SEQ ID NO: 10501 - protein, 153 aa, Homo Sapiens
MQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGS

SEQ ID NO: 10502 - protein, 226 aa, Homo Sapiens
MQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTH

SEQ ID NO: 10503 - protein, 154 aa, Homo Sapiens
  misc_feature (1)..(1): Xaa can be any naturally occurring amino acid
XCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHGCGHFCHGKVEFRLGAVAEACTLSTLGG

SEQ ID NO: 10504 - protein, 133 aa, Homo Sapiens
  misc_feature (1)..(1): Xaa can be any naturally occurring amino acid
XRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGTLLWT

SEQ ID NO: 10505 - protein, 185 aa, Homo Sapiens
  misc_feature (1)..(1): Xaa can be any naturally occurring amino acid
XSWGLRCMQCKTNGDCRVEECALGQDLCRTTIVRLWEGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTH

SEQ ID NO: 10506 - protein, 144 aa, Homo Sapiens
MPAEKTVQVKNVMDKNGDAYGFYNNSVKTTGWGILEIRAGYGSQTLSNEIIMFVAGFLEGYLTAPHMNDHYTNLYPQLITKPSIMDKVQDFMEKQDKWTRKNIKEYKTDSFWRHTGYVMAQIDGLYVGAKKRAILEGTKPMTLF

SEQ ID NO: 10507 - protein, 40 aa, Homo Sapiens
MTRGGPGGRPGLPQPPPLLLLLLLLPLLLVTAEPPKPADT

SEQ ID NO: 10508 - protein, 553 aa, Homo Sapiens
MTRGGPGGRPGLPQPPPLLLLLLLLPLLLVTAEPPKPAGVYYATAYWMPAEKTVQVKNVMDKNGDAYGFYNNSVKTTGWGILEIRAGYGSQTLSNEIIMFVAGFLEGYLTAPHMNDHYTNLYPQLITKPSIMDKVQDFMEKQDKWTRKNIKEYKTDSFWRHTGYVMAQIDGLYVGAKKRAILEGTKPMTLFQIQFLNSVGDLLDLIPSLSPTKNGSLKVFKRWDMGHCSALIKVLPGFENILFAHSSWYTYAAMLRIYKHWDFNVIDKDTSSSRLSFSSYPGFLESLDDFYILSSGLILLQTTNSVFNKTLLKQVIPETLLSWQRVRVANMMADSGKRWADIFSKYNSGTYNNQYMVLDLKKVKLNHSLDKGTLYIVEQIPTYVEYSEQTDVLRKGYWPSYNVPFHEKIYNWSGYPLLVQKLGLDYSYDLAPRAKIFRRDQGKVTDTASMKYIMRYNNYKKDPYSRGDPCNTICCREDLNSPNPSPGGCYDTKVADIYLASQYTSYAISGPTVQGGLPVFRWDRFNKTLHQGMPEVYNFDFITMKPILKLDIK

SEQ ID NO: 10509 - protein, 52 aa, Homo Sapiens
DGQVPPASRSRSVLLDVSAGQLLMVDGRHPDAVAWANLTNAIRETGSSTCTG

SEQ ID NO: 10510 - protein, 589 aa, Homo Sapiens
MVGQMYCYPGSHLARALTRALALALVLALLVGPFLSGLAGAIPAPGGRWARDGQVPPASRSRSVLLDVSAGQLLMVDGRHPDAVAWANLTNAIRETGWAFLELGTSGQYNDSLQAYAAGVVEAAVSEELIYMHWMNTVVNYCGPFEYEVGYCERLKSFLEANLEWMQEEMESNPDSPYWHQVRLTLLQLKGLEDSYEGRVSFPAGKFTIKPLGFLLLQLSGDLEDLELALNKTKIKPSLGSGSCSALIKLLPGQSDLLVAHNTWNNYQHMLRVIKKYWLQFREGPWGDYPLVPGNKLVFSSYPGTIFSCDDFYILGSGLVTLETTIGNKNPALWKYVRPRGCVLEWVRNIVANRLASDGATWADIFKRFNSGTYNNQWMIVDYKAFIPGGPSPGSRVLTILEQIPGMVVVADKTSELYQKTYWASYNIPSFETVFNASGLQALVAQYGDWFSYDGSPRAQIFRRNQSLVQDMDSMVRLMRYNDFLHDPLSLCKACNPQPNGENAISARSDLNPANGSYPFQALRQRSHGGIDVKVTSMSLARILSLLAASGPTWDQVPPFQWSTSPFSGLLHMGQPDLWKFAPVKVSWD

SEQ ID NO: 10511 - protein, 557 aa, Homo Sapiens
MVGQMYCYPGSHLARALTRALALALVLALLVGPFLSGLAGAIPAPGGRWARDGQVPPASRSRSVLLDVSAGQLLMVDGRHPDAVAWANLTNAIRETGWAFLELGTSGQYNDSLQAYAAGVVEAAVSEELIYMHWMNTVVNYCGPFEYEVGYCERLKSFLEANLEWMQEEMESNPDSPYWHQVRLTLLQLKGLEDSYEGRVSFPAGKFTIKPLGFLLLQLSGDLEDLELALNKTKIKPSLGSGSCSALIKLLPGQSDLLVAHNTWNNYQHMLRVIKKYWLQFREGPWGDYPLVPGNKLVFSSYPGTIFSCDDFYILGSGLVTLETTIGNKNPALWKYVRPRGCVLEWVRNIVANRLASDGATWADIFKRFNSGTGMVVVADKTSELYQKTYWASYNIPSFETVFNASGLQALVAQYGDWFSYDGSPRAQIFRRNQSLVQDMDSMVRLMRYNDFLHDPLSLCKACNPQPNGENAISARSDLNPANGSYPFQALRQRSHGGIDVKVTSMSLARILSLLAASGPTWDQVPPFQWSTSPFSGLLHMGQPDLWKFAPVKVSWD

SEQ ID NO: 10512 - protein, 136 aa, Homo Sapiens
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPR

SEQ ID NO: 10513 - protein, 810 aa, Homo Sapiens
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 10514 - protein, 166 aa, Homo Sapiens
MEHKEVVLLLLLFLKSGQGEPLDDYVNTQGASLFSVTKKQLGAGSIEECAAKCEEDEEFTCRYFHCRCTYAGICNSDGKAFQYHSKEQQCVIMAENRKSSIIIRMRDVVLFEKKVYLSECKTGNGKNYRGTMSKTKNGITCQKWSSTSPHRPRFSPATHPSEGLEE

SEQ ID NO: 10515 - protein, 96 aa, Homo Sapiens
MEHKEVVLLLLLFLKSGQGEPLDDYVNTQGPSLFSVTKKQLGAGSREECAAKCEEDKEFTCRAFQYHSKEQQCVIMAENRKSSIIIRMRDAVLFEK

SEQ ID NO: 10516 - protein, 96 aa, Homo Sapiens; identical to SEQ ID NO: 10515

SEQ ID NO: 10517 - protein, 96 aa, Homo Sapiens; identical to SEQ ID NO: 10515

SEQ ID NO: 10518 - protein, 89 aa, Homo Sapiens
MEHKEVVLLLLLFLKSGQGEPLDDYVNTQGPSLFSVTKKQLGAGSREECAAKCEEDKEFTCRYFHRRCTYPEICNSDGHSNITVKSNNV

SEQ ID NO: 10519 - protein, 96 aa, Homo Sapiens; identical to SEQ ID NO: 10515

SEQ ID NO: 10520 - protein, 96 aa, Homo Sapiens; identical to SEQ ID NO: 10515

SEQ ID NO: 10521 - protein, 225 aa, Homo Sapiens
MRPLLLLALLGWLLLAEAKGDAKPEAPCCQEGLRAGGSGSLHLGRDFTVLAGARGSPSPSVSSIPRFWIPGSDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDS

SEQ ID NO: 10522 - protein, 727 aa, Homo Sapiens
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKREQINITLDHRCRIFQNLDGALDEVVLKFEMGHVRARNLAYDTLPVLIHGNGPTKLQLNYLGNYIPRFWTFETGCTVCDEGLRSLKGIGDEALPTVLVGVFIEQPTPFVSLFFQRLLRLHYPQKHMRLFIHNHEQHHKAQVEEFLAQHGSEYQSVKLVGPEVRMANADARNMGADLCRQDRSCTYYFSVDADVALTEPNSLRLLIQQNKNVIAPLMTRHGRLWSNFWGALSADGYYARSEDYVDIVQGRRVGVWNVPYISNIYLIKGSALRGELQSSDLFHHSKLDPDMAFCANIRQQDVFMFLTNRHTLGHLLSLDSYRTTHLHNDLWEVFSNPEDWKEKYIHQNYTKALAGKLVETPCPDVYWFPIFTEVACDELVEEMEHFGQWSLGNNKDNRIQGGYENVPTIDIHMNQIGFEREWHKFLLEYIAPMTEKLYPGYYTRAQFDLAFVVRYKPDEQPSLMPHHDASTFTINIALNRVGVDYEGGGCRFLRYNCSIRAPRKGWTLMHPGRLTHYHEGLPTTRGTRYIAVSFVDP

SEQ ID NO: 10523 - protein, 283 aa, Homo Sapiens
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKREQINITLDHRCRIFQNLDGALVSPWGQGHLPGACYELTASVLTSELSVMPSFPAVVLQLNYLGNYIPRFWTFETGCTVCDEGLRSLKGIG

SEQ ID NO: 10524 - protein, 98 aa, Homo Sapiens
MGGCTVKPQLLLLALVLHPWNPCLGADSEKPSSIPTDKLLVITVATKESDGFHRFMQSAKYFNYTVKKEGSVSQVFSTNKRRTRRYLGPWSRRRMERW

SEQ ID NO: 10525 - protein, 758 aa, Homo Sapiens
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 10526 - protein, 737 aa, Homo Sapiens
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 10527 - protein, 418 aa, Homo Sapiens
MLENHILHKRIYILTFFSQQIFILCHAHFIFFFTVRDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 10528 - protein, 703 aa, Homo Sapiens
MQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 10529 - protein, 229 aa, Homo Sapiens
MTRFGVRLYKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGP

SEQ ID NO: 10530 - protein, 171 aa, Homo Sapiens
MGHFKDVVTVFLQEILFSFGPCEDAVITKAAPGASPGRRGEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSG

SEQ ID NO: 10531 - protein, 76 aa, Homo Sapiens
MTSSGPGPRFLLLLPLLLPPAASASDRPRGRDPVNPEKLLVITVATAETEGYLRFLRSAEFFNYTVRTLGLGEEWR

SEQ ID NO: 10532 - protein, 738 aa, Homo Sapiens
MTSSGPGPRFLLLLPLLLPPAASASDRPRGRDPVNPEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQPPPRVFLAVFVEQPTPFLPRFLQRLLLLDYPPDRVTLFLHNNEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEDSRLAGGYENVPTVDIHMKQVGYEDQWLQLLRTYVGPMTESLFPGYHTKARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 10533 - protein, 125 aa, Homo Sapiens
TLGLGEEWRGGDVARTVGGGQKVRWLKKEMEKYADREDMIIMFVDSYDVILAGSPTELLKKFVQSGSRLLFSAESFCWPEWGLAEQYPEDSSVLPPPSTKSCASGSTRMMTTTSCSTHGSTWTQD

SEQ ID NO: 10534 - protein, 270 aa, Homo Sapiens
  misc_feature (1)..(1): Xaa can be any naturally occurring amino acid
XFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQR

SEQ ID NO: 10535 - protein, 66 aa, Homo Sapiens
  misc_feature (1)..(1): Xaa can be any naturally occurring amino acid
XFSLDADAVLTNLQTLRILIEENRKVIAPMLSRHGKLWSNFWGALSPDEYYARSEDYVELVQRKRV

SEQ ID NO: 10536 - protein, 264 aa, Homo Sapiens
  misc_feature (1)..(1): Xaa can be any naturally occurring amino acid
XNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 10537 - protein, 398 aa, Homo Sapiens
MALFGALFLALLAGAHAEFPGCKIRVTSKALELVKQEGLRFLEQELETITIPDLRGKEGHFYYNISEKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 10538 - protein, 493 aa, Homo Sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 10539 - protein, 493 aa, Homo Sapiens; identical to SEQ ID NO: 10538

SEQ ID NO: 10540 - protein, 441 aa, Homo Sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFLKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 10541 - protein, 405 aa, Homo Sapiens
MLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 10542 - protein, 1894 aa, Homo Sapiens
MKAMPWNWTCLLSHLLMVGMGSSTLLTRQPAPLSQKQRSFVTFRGEPAEGFNHLVVDERTGHIYLGAVNRIYKLSSDLKVLVTHETGPDEDNPKCYPPRIVQTCNEPLTTTNNVNKMLLIDYKENRLIACGSLYQGICKLLRLEDLFKLGEPYHKKEHYLSGVNESGSVFGVIVSYSNLDDKLFIATAVDGKPEYFPTISSRKLTKNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKIRVDGPRGNALQYETVQVVDPGPVLRDMAFSKDHEQLYIMSERQLTRVPVESCGQYQSCGECLGSGDPHCGWCVLHNTCTRKERCERSKEPRRFASEMKQCVRLTVHPNNISVSQYNVLLVLETYNVPELSAGVNCTFEDLSEMDGLVVGNQIQCYSPAAKEVPRIITENGDHHVVQLQLKSKETGMTFASTSFVFYNCSVHNSCLSCVESPYRCHWCKYRHVCTHDPKTCSFQEGRVKLPEDCPQLLRVDKILVPVEVIKPITLKAKNLPQPQSGQRGYECILNIQGSEQRVPALRFNSSSVQCQNTSYSYEGMEINNLPVELTVVWNGHFNIDNPAQNKVHLYKCGAMRESCGLCLKADPDFACGWCQGPGQCTLRQHCPAQESQWLELSGAKSKCTNPRITEIIPVTGPREGGTKVTIRGENLGLEFRDIASHVKVAGVECSPLVDGYIPAEQIVCEMGEAKPSQHAGFVEICVAVCRPEFMARSSQLYYFMTLTLSDLKPSRGPMSGGTQVTITGTNLNAGSNVVVMFGKQPCLFHRRSPSYIVCNTTSSDEVLEMKVSVQVDRAKIHQDLVFQYVEDPTIVRIEPEWSIVSGNTPIAVWGTHLDLIQNPQIRAKHGGKEHINICEVLNATEMTCQAPALALGPDHQSDLTERPEEFGFILDNVQSLLILNKTNFTYYPNPVFEAFGPSGILELKPGTPIILKGKNLIPPVAGGNVKLNYTVLVGEKPCTVTVSDVQLLCESPNLIGRHKVMARVGGMEYSPGMVYIAPDSPLSLPAIVSIAVAGGLLIIFIVAVLIAYKRKSRESDLTLKRLQMQMDNLESRVALECKEAFAELQTDIHELTSDLDGAGIPFLDYRTYTMRVLFPGIEDHPVLRDLEVPGYRQERVEKGLKLFAQLINNKVFLLSFIRTLESQRSFSMRDRGNVASLIMTVLQSKLEYATDVLKQLLADLIDKNLESKNHPKLLLRRTESVAEKMLTNWFTFLLYKFLKECAGEPLFSLFCAIKQQMEKGPIDAITGEARYSLSEDKLIRQQIDYKTLVLSCVSPDNANSPEVPVKILNCDTITQVKEKILDAIFKNVPCSHRPKAADMDLEWRQGSGARMILQDEDITTKIENDWKRLNTLAHYQVPDGSVVALVSKQVTAYNAVNNSTVSRTSASKYENMIRYTGSPDSLRSRTPMITPDLESGVKMWHLVKNHEHGDQKEGDRGSKMVSEIYLTRLLATKGTLQKFVDDLFETIFSTAHRGSALPLAIKYMFDFLDEQADKHGIHDPHVRHTWKSNCLPLRFWVNMIKNPQFVFDIHKNSITDACLSVVAQTFMDSCSTSEHRLGKDSPSNKLLYAKDIPSYKNWVERYYSDIGKMPAISDQDMNAYLAEQSRMHMNEFNTMSALSEIFSYVGKYSEEILGPLDHDDQCGKQKLAYKLEQVITLMSLDS

SEQ ID NO: 10543 - protein, 1894 aa, Homo Sapiens; identical to SEQ ID NO: 10542

SEQ ID NO: 10544 - protein, 522 aa, Homo Sapiens
MKAMPWNWTCLLSHLLMVGMGSSTLLTRQPAPLSQKQRSFVTFRGEPAEGFNHLVVDERTGHIYLGAVNRIYKLSSDLKVLVTHETGPDEDNPKCYPPRIVQTCNEPLTTTNNVNKMLLIDYKENRLIACGSLYQGICKLLRLEDLFKLGEPYHKKEHYLSGVNESGSVFGVIVSYSNLDDKLFIATAVDGKPEYFPTISSRKLTKNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKSFGTGPQGGITQEWIGVEGDPPGANIASQEQMLCVYLQCSSHKAISDQRVQPLLCCFLNVPGNSS

SEQ ID NO: 10545 - protein, 492 aa, Homo Sapiens
MKAMPWNWTCLLSHLLMVGMGSSTLLTRQPAPLSQKQRSFVTFRGEPAEGFNHLVVDERTGHIYLGAVNRIYKLSSDLKVLVTHETGPDEDNPKCYPPRIVQTCNEPLTTTNNVNKMLLIDYKENRLIACGSLYQGICKLLRLEDLFKLGEPYHKKEHYLSGVNESGSVFGVIVSYSNLDDKLFIATAVDGKPEYFPTISSRKLTKNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKMPGTSLCPTLELQTGPRSHRATVTLELLFSSCSSN

SEQ ID NO: 10546 - protein, 160 aa, Homo Sapiens
GPDVTAGGPVEARQHPYALQCPGWSHPHPVQGGGLPAAGGQPAGPAWGAPCPPGGGEPGVAPGAADRRGGRGQVQERQREREGADEGHHRDLPDAAALSQGHTAAVCGQLLPERAGLGTRCHLQSSTSSTSWTSRQRSTTSRMKTPSTSGRRTAYRSGSG

SEQ ID NO: 10547 - protein, 162 aa, Homo Sapiens
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGP

SEQ ID NO: 10548 - protein, 1838 aa, Homo Sapiens
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVPLSLILPLVIVPMVVVIAVSVYCYWRKSQQAEREYEKIKSQLEGLEESVRDRCKKEFTDLMIEMEDQTNDVHEAGIPVLDYKTYTDRVFFLPSKDGDKDVMITGKLDIPEPRRPVVEQALYQFSNLLNSKSFLINFIHTLENQREFSARAKVYFASLLTVALHGKLEYYTDIMHTLFLELLEQYVVAKNPKLMLRRSETVVERMLSNWMSICLYQYLKDSAGEPLYKLFKAIKHQVEKGPVDAVQKKAKYTLNDTGLLGDDVEYAPLTVSVIVQDEGVDAIPVKVLNCDTISQVKEKIIDQVYRGQPCSCWPRPDSVVLEWRPGSTAQILSDLDLTSQREGRWKRVNTLMHYNVRDGATLILSKVGVSQQPEDSQQDLPGERHALLEEENRVWHLVRPTDEVDEGKSKRGSVKEKERTKAITEIYLTRLLSVKGTLQQFVDNFFQSVLAPGHAVPPAVKYFFDFLDEQAEKHNIQDEDTIHIWKTNSLPLRFWVNILKNPHFIFDVHVHEVVDASLSVIAQTFMDACTRTEHKLSRDSPSNKLLYAKEISTYKKMVEDYYKGIRQMVQVSDQDMNTHLAEISRAHTDSLNTLVALHQLYQYTQKYYDEIINALEEDPAAQKMQLAFRLQQIAAALENKVTDL

SEQ ID NO: 10549 - protein, 477 aa, Homo Sapiens
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQ

SEQ ID NO: 10550 - protein, 1838 aa, Homo Sapiens; identical to SEQ ID NO: 10548

SEQ ID NO: 10551 - protein, 347 aa, Homo Sapiens [sequence omitted]

SEQ ID NO: 10552 - protein, 189 aa, Homo Sapiens
  misc_feature (1)..(1): Xaa can be any naturally occurring amino acid
XEVWGAAPVCHWPPGDTGPDASGGLLRGVPRAQPRHLLHLPRKPRTASLRAATKLCQVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLP

SEQ ID NO: 10553 - protein, 84 aa, Homo Sapiens
  misc_feature (1)..(1): Xaa can be any naturally occurring amino acid
XTDVNFQGKNLDTVKVWMSGGGGRGKPTEDVQRLLQTQGSSLHVGSDLLKFMEPVTMQESGTFAFRTPKLSHDANETLPLHLYV

SEQ ID NO: 10554 - protein, 234 aa, Homo Sapiens
YKPFHGDIQCGGHAPGSSKSFPCGSEHLPYPLGSRDGLRGTAVLQRGGLNLTAVTVAAENNHTVAFLEWRPGSTAQILSDLDLTSQREGRWKRVNTLMHYNVRDGATLILSKVGVSQQPEDSQQDLPGERHALLEEENRVWHLVRPTDEVDEGKSKRGSVKEKERTKAITEIYLTRLLSVKGTLQQFVDNFFQSVLAPGHAVPPAVKYFFDFLDEQAEKHNIQDEDTIHIWKTN

SEQ ID NO: 10555 - protein, 502 aa, Homo Sapiens
MAQRCVCVLALVAMLLLVFPTVSRSMGPRSGEHQRASRIPSQFSKEERVAMKEALKGAIQIPTVTFSSEKSNTTALAEFGKYIHKVFPTVVSTSFIQHEVVEEYSHLFTIQGSDPSLQPYLLMAHFDVVPAPEEGWEVPPFSGLERDGIIYGRGTLDDKNSVMALLQALELLLIRKYIPRRSFFISLGHDEESSGTGAQRISALLQSRGVQLAFIVDEGGFILDDFIPNFKKPIALIAVSEKGSMNLMLQVNMTSGHSSAPPKETSIGILAAAVSRLEQTPMPIIFGSGTVVTVLQQLANEFPFPVNIILSNPWLFEPLISRFMERNPLTNAIIRTTTALTIFKAGVKFNVIPPVAQATVNFRIHPGQTVQEVLELTKNIVADNRVQFHVLSAFDPLPVSPSDDKALGYQLLRQTVQSVFPEVNITAPVTSIGNTDSRFFTNLTTGIYRFYPIYIQPEDFKRIHGVNEKISVQAYETQVKFIFELIQNADTDQEPVSHLHKL

SEQ ID NO: 10556 - protein, 165 aa, Homo Sapiens
MAKMNLSSYILILTFSLFSQGILLSASKSIRNLDDDMVFNTFRLGKGFQKEDTAEKSVIAPSLEQYKNDESSFMNEEENKVSKNTGSKHNFLNHGLPLNLAIKPYLALKGSVAFPAENGVQNTESTQEKREIGDEENSAKFPIGRRDFDMLRCMLGRVYRPCWQV

SEQ ID NO: 10557 - protein, 290 aa, Homo Sapiens
MDLVLKRCLLHLAVIGALLAVGATKGGQVSLKVSNDGPTLIGANASFSIALNFPGSQKVLPDGQVIWVNNTIINGSQVWGGQPVYPQETDDACIFPDGGPCPSGSWSQKRSFVYVWKTWEGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 10558 - protein, 575 aa, Homo Sapiens
MDLVLKRCLLHLAVIGALLAVGATKGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 10559 - protein, 151 aa, Homo Sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVY

SEQ ID NO: 10560 - protein, 344 aa, Homo Sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEAT

SEQ ID NO: 10561 - protein, 668 aa, Homo Sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPVPGILLTGQEAGLGQVPLIVGILLVLMAVVLASLIYRRRLMKQDFSVPQLPHSSSHWLRLPRIFCSCPIGENSPLLSGQQV

SEQ ID NO: 10562 - protein, 661 aa, Homo Sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 10563 - protein, 661 aa, Homo Sapiens; identical to SEQ ID NO: 10562

SEQ ID NO: 10564 - protein, 661 aa, Homo Sapiens; identical to SEQ ID NO: 10562

SEQ ID NO: 10565 - protein, 296 aa, Homo Sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWVPGTTDGHRPTAEAPNTTAGQVPTTEVVGTTPGQAPTAEPSGTTSVQVPTTEVISTAPVQMPTAESTAAQVTTTEWVETTARELPIPEPEGPDASSIMSTESITGSLGPLLDGTATLRLVKRQVPLDCVLYRYGSFSVTL

SEQ ID NO: 10566 - protein, 299 aa, Homo Sapiens
MDLVLKRCLLHLAVIGALLAVGATKVPRNQDWLGVSRQLRTKAWNRQLYPEWTEAQRLDCWRGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGT

SEQ ID NO: 10567 - protein, 134 aa, Homo Sapiens
MGKEEIPRPTLTSVKTLLYTKEFPQTVKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACI

SEQ ID NO: 10568 - protein, 452 aa, Homo Sapiens
  misc_feature (1)..(1): Xaa can be any naturally occurring amino acid
XQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPVPGILLTGQEAGLGQVPLI

SEQ ID NO: 10569 - protein, 252 aa, Homo Sapiens
MAELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 10570 - protein, 227 aa, Homo Sapiens
MHRLMGVNSTAAAAAGQPNVSCTCNCKRSLFQSMEISCHGFPVCKSHQHQEWKSLCWSLRSPGGASSITGFGSMKVTNPAMNLPECQWLRIQKAELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLR

SEQ ID NO: 10571 - protein, 287 aa, Homo Sapiens
MHRLMGVNSTAAAAAGQPNVSCTCNCKRSLFQSMEITELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 10572 - protein, 237 aa, Homo Sapiens
MMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 10573 - protein, 237 aa, Homo Sapiens; identical to SEQ ID NO: 10572

SEQ ID NO: 10574 - protein, 237 aa, Homo Sapiens; identical to SEQ ID NO: 10572

SEQ ID NO: 10575 - protein, 208 aa, Homo Sapiens
MPAIPAHGAELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVI

SEQ ID NO: 10576 - protein, 465 aa, Homo Sapiens
MLPLWTLSLLLGAVAGKEVCYERLGCFSDDSPWSGITERPLHILPWSPKDVNTRFLLYTNENPNNFQEVAADSSSISGSNFKTNRKTRFIIHGFIDKGEENWLANVCKNLFKVESVNCICVDWKGGSRTGYTQASQNIRIVGAEVAYFVEFLQSAFGYSPSNVHVIGHSLGAHAAGEAGRRTNGTIGRITGLDPAEPCFQGTPELVRLDPSDAKFVDVIHTDGAPIVPNLGFGMSQVVGHLDFFPNGGVEMPGCKKNILSQIVDIDGIWEGTRDFAACNHLRSYKYYTDSIVNPDGFAGFPCASYNVFTANKCFPCPSGGCPQMGHYADRYPGKTNDVGQKFYLDTGDASNFARWRYKVSVTLSGKKVTGHILVSLFGNKGNSKQYEIFKGTLKPDSTHSNEFDSDVDVGDLQMVKFIWYNNVINPTLPRVGASKIIVETNVGKQFNFCSPETVREEVLLTLTPC

SEQ ID NO: 10577 - protein, 179 aa, Homo Sapiens
KLFEVEEVNCICVDWKKGSQATYTQAANNVRVVGAQVAQMLDILLTEYSYPPSKVHLIGHSLGAHVAGEAGSKTPGLSRITGLDPVEASFESTPEEVRLDPSDADFVDVIHTDAAPLIPFLGFGTNQQMGHLDFFPNGGESMPGCKKNALSQIVDLDGIWAGQVLPVSRSRMPTDGSLC

SEQ ID NO: 10578 - protein, 132 aa, Homo Sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQAT

SEQ ID NO: 10579 - protein, 191 aa, Homo Sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLTEYSYPPSKVHLIGHSLGAHVAGEAGSKTPGLSRIT

SEQ ID NO: 10580 - protein, 467 aa, Homo Sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLTEYSYPPSKVHLIGHSLGAHVAGEAGSKTPGLSRITGLDPVEASFESTPEEVRLDPSDADFVDVIHTDAAPLIPFLGFGTNQQMGHLDFFPNGGESMPGCKKNALSQIVDLDGIWAGTRDFVACNHLRSYKYYLESILNPDGFAAYPCTSYKSFESDKCFPCPDQGCPQMGHYADKFAGRTSEEQQKFFLNTGEASNFARWRYGVSITLSGRTATGQIKVALFGNKGNTHQYSIFRGILKPGSTHSYEFDAKLDVGTIEKVKFLWNNNVINPTLPKVGATKITVQKGEEKTVYNFCSEDTVREDTLLTLTPC

SEQ ID NO: 10581 - protein, 467 aa, Homo Sapiens; identical to SEQ ID NO: 10580

SEQ ID NO: 10582 - protein, 467 aa, Homo Sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLVKYSYPPSKVHLIGHSLGAHVAGEAGSKTPGLSRITGLDPVEASFESTPEEVRLDPSDADFVDVIHTDAAPLIPFLGFGTNQQMGHLDFFPNGGESMPGCKKNALSQIVDLDGIWAGTRDFVACNHLRSYKYYLESILNPDGFAAYPCTSYKSFESDKCFPCPDQGCPQMGHYADKFAGRTSEEQQKFFLNTGEASNFARWRYGVSITLSGRTATGQIKVALFGNKGNTHQYSIFRGILKPGSTHSYEFDAKLDVGTIEKVKFLWNNNVINPTLPKVGATKITVQKGEEKTVYNFCSEDTVREDTLLTLTPC

SEQ ID NO: 10583 - protein, 118 aa, Homo Sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKQPGASPRA

SEQ ID NO: 10584 - protein, 185 aa, Homo Sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKTEYSYPPSKVHLIGHSLGAHVAGEAGSKTPGLSRITGLDPVEASFESTPEEVRLDPSDADFVDVIHTDAAPLIPF

SEQ ID NO: 10585 - protein, 163 aa, Homo Sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKTPGLSRITGLDPVEASFESTPEEVRLDPSDADFVDVIHTDAAPLIPFLGFGTN

SEQ ID NO: 10586 - protein, 467 aa, Homo Sapiens
MLGIWIVAFLFFGTSRGKEVCYERLGCFKDGLPWTRTFSTELVGLPWSPEKINTRFLLYTIHNPNAYQEISAVNSSTIQASYFGTDKITRINIAGWKTDGKWQRDMCNVLLQLEDINCINLDWINGSREYIHAVNNLRVVGAEVAYFIDVLMKKFEYSPSKVHLIGHSLGAHLAGEAGSRIPGLGRITGLDPAGPFFHNTPKEVRLDPSDANFVDVIHTNAARILFELGVGTIDACGHLDFYPNGGKHMPGCEDLITPLLKFNFNAYKKEMASFFDCNHARSYQFYAESILNPDAFIAYPCRSYTSFKAGNCFFCSKEGCPTMGHFADRFHFKNMKTNGSHYFLNTGSLSPFARWRHKLSVKLSGSEVTQGTVFLRVGGAVRKTGEFAIVSGKLEPGMTYTKLIDADVNVGNITSVQFIWKKHLFEDSQNKLGAEMVINTSGKYGYKSTFCSQDIMGPNILQNLKPC

SEQ ID NO: 10587 - protein, 112 aa, Homo Sapiens
MARSSWQLSPAAPEHVAAALYQPRASEMQHLRRMPRVRSLFQEQEEPEPGMEEAGEMEQKQLQKRFGGFTGARKSARKLANQKRFSEFMRQYLVLSMQSSQRRRTLHQNGNV

SEQ ID NO: 10588 - protein, 154 aa, Homo Sapiens
MKVLLCDLLLLSLFSSVFSSCQRDCLTCQEKLHPALDSFDLEVCILECEEKVFPSPLWTPCTKVMARSSWQLSPAAPEHVAAALYQPRASEMQHLRRMPRVRSLFQEQEEPEPGMEEAGEMEQKQLQKRFGGFTGARKSARKLANQKRFSEFMR

SEQ ID NO: 10589 - protein, 176 aa, Homo Sapiens
MKVLLCDLLLLSLFSSVFSSCQRDCLTCQEKLHPALDSFDLEVCILECEEKVFPSPLWTPCTKVMARSSWQLSPAAPEHVAAALYQPRASEMQHLRRMPRVRSLFQEQEEPEPGMEEAGEMEQKQLQKRFGGFTGARKSARKLANQKRFSEFMRQYLVLSMQSSQRRRTLHQNGNV

SEQ ID NO: 10590 - protein, 93 aa, Homo Sapiens
MENGYTYEDYKNTAEWLLSHTKHRPQVAIICGSGLGGLTDKLTQAQIFDYGEIPNFPRSTVPGHAGRLVFGFLNGRACVMMQGRFHMYEGYPL

SEQ ID NO: 10591 - protein, 289 aa, Homo Sapiens
MENGYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMGEQRELQEGTYVMVAGPSFETVAECRVLQKLGADAVGMSTVPEVIVARHCGLRVFGFSLITNKVIMDYESLEKANHEEVLAAGKQAAQKLEQFVSILMASIPLPDKAS

SEQ ID NO: 10592 - protein, 61 aa, Homo Sapiens
MMQGRFHMYEGYPLWKVTFPVRVFHLLGVDTLVVTNAAGGLNPKFEVGDIMLIRDHINLPG

SEQ ID NO: 10593 - protein, 221 aa, Homo Sapiens
MQRGLALSLVSGARRQSHAAASAGRDARGNRAGVAPPEQEGDRYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMG

SEQ ID NO: 10594 - protein, 166 aa, Homo Sapiens
MARLRSGMESILPPSAHELAQNRLHVSITNAKTRENHLVSTFSSREDLIKVLLASSFVPIYAGLKLVEYKGQKWVDGGLTNALPILPVGRTVTISPFSGRLDISPQDKGQLDLYVNIAKQDIMLSLANLVRLNQALFPPSKRKMESLYQCGFDDTVKFLLKENWFE

SEQ ID NO: 10595 - protein, 190 aa, Homo Sapiens
MKHINLSFAACGFLGIYHLGAASALCRHGKKLVKDVKAFAGASAGSLVASVLLTAPEKIEECNQFTYKFAEEIRRQSFGAVTPGYDFMARLRSGMESILPPSAHELAQNRLHVSITNAKTRENHLVSTFSSREDLIKVLLASSFVPIYAGLKLVEYKGQKWVDGGLTNALPILPVGRTVTISPFSGRLDI

SEQ ID NO: 10596 - protein, 253 aa, Homo Sapiens
MKHINLSFAACGFLGIYHLGAASALCRHGKKLVKDVKAFAGASAGSLVASVLLTAPEKIEECNQFTYKFAEEIRRQSFGAVTPGYDFMARLRSGMESILPPSAHELAQNRLHVSITNAKTRENHLVSTFSSREDLIKVLLASSFVPIYAGLKLVEYKGQKWVDGGLTNALPILPVGRTVTISPFSGRLDISPQDKGQLDLYVNIAKQDIMLSLANLVRLNQALFPPSKRKMESLYQCGFDDTVKFLLKENWFE

SEQ ID NO: 10597 - protein, 253 aa, Homo Sapiens; identical to SEQ ID NO: 10596

SEQ ID NO: 10598 - protein, 135 aa, Homo Sapiens
LQLQRNQLRMLEPEPLAGLDQLRELSLAHNRLRVGDIGPGTWHELQALQMLDLSHNELSFVPPDLPEALEELHLEGNRIGHVGPEAFLSTPRLRALFLRCPEGDRRGGGGQGRAWEGHDRLSVQGQQASHDEHRG

SEQ ID NO: 10599 - protein, 512 aa, Homo Sapiens
MAESGLAMWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEGLPDEAFESLTQLQHLCVAHNKLSVAPQFLPRSLRVADLAANQVMEIFPLTFGEKPALRSVYLHNNQLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 10600 - protein, 32 aa, Homo Sapiens
MAWTFECSRTTSPEPLSTSPCRTTSSRNSPTM

SEQ ID NO: 10601 - protein, 430 aa, Homo Sapiens
MAWTFECSRTTSPEPLSTSPCRTTSSRNSPTMSCPASVACEPSTSTTTSSPPKLSVAPQFLPRSLRVADLAANQVMEIFPLTFGEKPALRSVYLHNNQLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 10602 - protein, 164 aa, Homo Sapiens
MAWTFECSRTTSPEPLSTSPCRTTSSRNSPTMSCPASVACEPSTSTTTSSPPKNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRP

SEQ ID NO: 10603 - protein, 123 aa, Homo Sapiens
MGRPTQWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEEQSHLQGAPRSP

SEQ ID NO: 10604 - protein, 510 aa, Homo Sapiens
MGRPTQWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEGLPDEAFESLTQLQHLCVAHNKLSVAPQFLPRSLRVADLAANQVMEIFPLTFGEKPALRSVYLHNNQLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 10605 - protein, 421 aa, Homo Sapiens
MGRPTQWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEGLPDEAFESLTQLQHLCVAHNKNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 10606 - protein, 505 aa, Homo Sapiens
MWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEGLPDEAFESLTQLQHLCVAHNKLSVAPQFLPRSLRVADLAANQVMEIFPLTFGEKPALRSVYLHNNQLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 10607 - protein, 574 aa, Homo Sapiens
MWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEGLPDEAFESLTQLQHLCVAHNKLSVAPQFLPRSLRVADLAANQVMEIFPLTFGEKPALRSVYLHNNQLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQMLDLSHNELSFVPPDLPEALEELHLEGNRIGHVGPEAFLSTPRLRALFLRANRLHMTSIAAEAFLGLPNLRVVDTAGNPEQVLIRLPPTTPRGPRAGGP

SEQ ID NO: 10608 - protein, 151 aa, Homo Sapiens
RRLPRLRGHRHPQPLQQPAQLPAAQPAALTRAAPPAGSPANNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRP

SEQ ID NO: 10609 - protein, 182 aa, Homo Sapiens
  misc_feature (1)..(1): Xaa can be any naturally occurring amino acid
XFESLTQLQHLCVAHNKLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLY

SEQ ID NO: 10610 - protein, 388 aa, Homo Sapiens
MGAAAWARPLSVSFLLLLLPLPGMPAGSWDPAGYLLYCPCMGRFGNQADHFLGSLAFAKLLNRTLAVPPWIEYQHHKPPFTNLHVSYQKYFKLEPLQAYHRVISLEDFMEKLAPTHWPPEKRVAYCFEVAAQRSPDKKTCPMKEGNPFGPFWDQFHVSFNKSELFTGISFSASYREQWSQRFSPKEHPVLALPGAPAQFPVLEEHRPLQKYMVWSDEMVKTGEAQIHAHLVRPYVGIHLRIGSDWKNACAMLKDGTAGSHFMASPQCVGYSRSTAAPLTMTMCLPDLKEIQRAVKLWVRSLDAQSVYVATDSESYVPELQQLFKGKVKVVSLKPEVAQVDLYILGQADHFIGNCVSSFTAFVKRERDLQGRPSSFFGMDRPPKLRDEF

SEQ ID NO: 10611 - protein, 194 aa, Homo Sapiens
MGAAAWARPLSVSFLLLLLPLPGMPAGSWDPAGYLLYCPCMGRFGNQADHFLGSLAFAKLLNRTLAVPPWIEYQHHKPPFTNLHVSYQKYFKLEPLQAYHRVISLEDFMEKLAPTHWPPEKRVAYCFEVAAQRSPDKKTCPMKEGNPFGPFWDQFHVSFNKSELFTGISFSASYREQWSQRRENHSCVTLLFPR

SEQ ID NO: 10612 - protein, 424 aa, Homo Sapiens
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYRGWFWGYEETRGLNVSCLSVQGSASIVAPLLLRNTSARSVMLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEELKKLLPEMVRFEPTWEELELYKDGGVAIIDQWICAHARCLPTSLSAESGSGGFQRFFCPKYSVSEQMVACVHSGHFHTVCLLV

SEQ ID NO: 10613 - protein, 429 aa, Homo Sapiens
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYRGWFWGYEETRGLNVSCLSVQGSASIVAPLLLRNTSARSVMLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEELKKLLPEMVRFEPTWEELELYKDGGVAIIDQWICAHARFFIGTSVSTFSFRIHEEREILGLDPKTTYNRFCGDQEKACEQPTHWKITY

SEQ ID NO: 10614 - protein, 380 aa, Homo Sapiens
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYRGWFWGYEETRGLNVSCLSVQGSASIVAPLLLRNTSARSVMLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEELKKLLPEMVRFEPTWEELELYKDGGVAIIDQWICAHASS

SEQ ID NO: 10615 - protein, 212 aa, Homo Sapiens
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAGRRTACGVCFVVSQCSARDKESGGPFIDQVYVLQSYAEGWKEGTWEEKVDERPCIDQLLYSQDKHEYYRCLLRLLPLPQRMVLGL

SEQ ID NO: 10616 - protein, 141 aa, Homo Sapiens
MVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEELKKLLPEMVRFEPTWEELELYKDGGVAIIDQWICAHASS

SEQ ID NO: 10617 - protein, 265 aa, Homo Sapiens
  misc_feature (1)..(1): Xaa can be any naturally occurring amino acid
XQFIAESGGPFIDQVYVLQSYAEGWKEGTWEEKVDERPCIDQLLYSQDKHEYYRDGGLVSPKCRLPLKALTLPGLLWKSCQLTASMCPVPGQLALKHGRGWFWGYEETRGLNVSCLSVQGSASIVAPLLLRNTSARSVMLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEEL

SEQ ID NO: 10618 - protein, 111 aa, Homo Sapiens
MEWWASSPLRLWLLLFLLPSAQGRQKESGGLRAVPSLPLGLGVWPESRGAPPRGRLPGRCRGRCSSELGRRHRGALRRRVQNGKYLLTKLTGLWRITNHVQVKTAAATMVS

SEQ ID NO: 10619 - protein, 163 aa, Homo Sapiens
MEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKARLWKIGKIYL

SEQ ID NO: 10620 - protein, 187 aa, Homo Sapiens
MEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTCFISCVASGQRPHLCCISHGLASFLESVWFHCLS

SEQ ID NO: 10621 - protein, 392 aa, Homo Sapiens
MEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKKKNSTAYFRGSRTSPERDPLILLSRKNPKLVDAEYTKNQAWKSMKDTLGKPAAKDVHLVDHCKYKYLFNFRGVAASFRFKHLFLCGSLVFHVGDEWLEFFYPQLKPWVHYIPVKTDLSNVQELLQFVKANDDVAQEIAERGSQFIRNHLQMDDITCYWENLLSEYSKFLSYNVTRRKGYDQIIPKMLKTEL

SEQ ID NO: 10622 - protein, 189 aa, Homo Sapiens
  misc_feature (1)..(1): Xaa can be any naturally occurring amino acid
XCGAALPPAPQRGICSSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKK

SEQ ID NO: 10623 - protein, 334 aa, Homo Sapiens
MDPRGILKAFPKRQKIHADASSKPSCASALRCLCPESDIGADSACPGPAEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLR

SEQ ID NO: 10624 - protein, 188 aa, Homo Sapiens
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNT

SEQ ID NO: 10625 - protein, 470 aa, Homo Sapiens
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEAVPSVGPGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPT

SEQ ID NO: 10626 - protein, 575 aa, Homo Sapiens
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 10627 - protein, 575 aa, Homo Sapiens; identical to SEQ ID NO: 10626

SEQ ID NO: 10628 - protein, 575 aa, Homo Sapiens; identical to SEQ ID NO: 10626

SEQ ID NO: 10629 - protein, 269 aa, Homo Sapiens
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSV

SEQ ID NO: 10630 - protein, 487 aa, Homo Sapiens
MDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 10631 - protein, 152 aa, Homo Sapiens
MDYERALRLLRLPQLPPGAQLVKSAWLSLCLQERRLVDVAGFSIFIPSSPSLMMKPVMGKKPRLVQLIWKPSSVATTPPPLREIVSLAQPLLSWISGSVHSPQARRRPITTSISQRSWKFWPKPTVFRETSGGPWAMPRPSMPSRASISLSP

SEQ ID NO: 10632 - protein, 248 aa, Homo Sapiens
MEALCVCSLMPLHWSWILTASHLAAFFQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 10633 - protein, 218 aa, Homo Sapiens
MHHQKYLQRFLGGKREKKQKEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVP

SEQ ID NO: 10634 - protein, 298 aa, Homo Sapiens
MHHQKYLQRFLGGKREKKQKEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 10635 - protein, 300 aa, Homo Sapiens
MLMHHQKYLQRFLGGKREKKQKEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 10636 - protein, 246 aa, Homo Sapiens
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLPEGGPEPRSDGAKPGPREGKRSYSMEHFRWGKPVGKKRRPVKVYPNGAEDESAEAFPLEFKRELTGQRLREGDGPDGPADDGAGAQADLEHSLLVAAEKKDEGPYRMEHFRWGSPPKDKRYGGFMTSEKS

SEQ ID NO: 10637 - protein, 267 aa, Homo Sapiens
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLPEGGPEPRSDGAKPGPREGKRSYSMEHFRWGKPVGKKRRPVKVYPNGAEDESAEAFPLEFKRELTGQRLREGDGPDGPADDGAGAQADLEHSLLVAAEKKDEGPYRMEHFRWGSPPKDKRYGGFMTSEKSQTPLVTLFKNAIIKNAYKKGE

SEQ ID NO: 10638 - protein, 267 aa, Homo Sapiens; identical to SEQ ID NO: 10637

SEQ ID NO: 10639 - protein, 267 aa, Homo Sapiens; identical to SEQ ID NO: 10637

SEQ ID NO: 10640 - protein, 267 aa, Homo Sapiens; identical to SEQ ID NO: 10637

SEQ ID NO: 10641 - protein, 580 aa, Homo Sapiens
MHLSAVFNALLVSVLAAVLWKHVRLREHAATLEEELALSRQATEPAPALRIDYPKALQILMEGGTHMVCTGRTHTDRICRFKWLCYSNEAEEFIFFHGNTSVMLPNLGSRRFQPALLDLSTVEDHNTQYFNFVELPAAALRFMPKPVFVPDVALIANRFNPDNLMHVFHDDLLPLFYTLRQFPGLAHEARLFFMEGWGEGAHFDLYKLLSPKQPLLRAQLKTLGRLLCFSHAFVGLSKITTWYQYGFVQPQGPKANILVSGNEIRQFARFMTEKLNVSHTGVPLGEEYILVFSRTQNRLILNEAELLLALAQEFQMKTVTVSLEDHTFADVVRLVSNASMLVSMHGAQLVTTLFLPRGATVVELFPYAVNPDHYTPYKTLAMLPGMDLQYVAWRNMMPENTVTHPERPWDQGGITHLDRAEQARILQSREVPRHLCCRNPEWLFRIYQDTKVDIPSLIQTIRRVVKGRPGPRKQKWTVGLYPGKVREARCQASVHGASEARLTVSWQIPWNLKYLKVREVKYEVWLQEQGENTYVPYILALQNHTFTENIKPFTTYLVWVRCIFNKILLGPFADVLVCNT

SEQ ID NO: 10642 - protein, 580 aa, Homo Sapiens; identical to SEQ ID NO: 10641

SEQ ID NO: 10643 - protein, 355 aa, Homo Sapiens [sequence omitted]

SEQ ID NO: 10644 - protein, 77 aa, Homo Sapiens
MAKLIALTLLGMGLALFRNHQSSYQTRLNALREVQPVELPNCNLVKGIETGSEDLEILPNGLAFISSSWKNTSDGPE

SEQ ID NO: 10645 - protein, 375 aa, Homo Sapiens
MAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 10646 - protein, 354 aa, Homo Sapiens
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 10647 - protein, 354 aa, Homo Sapiens; identical to SEQ ID NO: 10646

SEQ ID NO: 10648 - protein, 219 aa, Homo Sapiens
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVYLCC

SEQ ID NO: 10649 - protein, 342 aa, Homo Sapiens
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 10650 - protein, 84 aa, Homo Sapiens
MGRLVAVGLLGIALALLGERLLALRNRLKASREVESVDLPHCHLIKGIEAGSEDIDILPNGLAFFSVVSVFFLPQIQQRRYKGI

SEQ ID NO: 10651 - protein, 84 aa, Homo Sapiens; identical to SEQ ID NO: 10650

SEQ ID NO: 10652 - protein, 50 aa, Homo Sapiens
MGRLVAVGLLGIALALLGERLLALRNRLKASREVESVDLPHCHLIKGIVW

SEQ ID NO: 10653 - protein, 32 aa, Homo Sapiens
MMDLKEEKPRARELRISRGFDLASFNPHGIST

SEQ ID NO: 10654 - protein, 53 aa, Homo Sapiens
MMDLKEEKPRARELRISRGFDLASFNPHGISTFIDNDDTVYLFVVNHPEFKNT

SEQ ID NO: 10655 - protein, 69 aa, Homo Sapiens
MMDLKEEKPRARELRISRGFDLASFNPHGISTFIDNDDTVYLFVVNHPEFKNTVEIFKFEEAENSLLHL

SEQ ID NO: 10656 - protein, 113 aa, Homo Sapiens
MMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNL

SEQ ID NO: 10657 - protein, 122 aa, Homo Sapiens
  misc_feature (1)..(1): Xaa can be any naturally occurring amino acid
XENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKILTISHLEGT

SEQ ID NO: 10658 - protein, 245 aa, Homo Sapiens
MGKLVALVLLGVGLSLVGEMFLAFRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYFASRMFCLRSPG

SEQ ID NO: 10659 - protein, 354 aa, Homo Sapiens
MGKLVALVLLGVGLSLVGEMFLAFRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 10660 - protein, 270 aa, Homo Sapiens
MGKLVALVLLGVGLSLVGEMFLAFRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKETFWQDAILIL

SEQ ID NO: 10661 - protein, 61 aa, Homo Sapiens
MGKLVALVLLGVGLSLVGEMFLAFRERVNASREVEPVEPENCHLIEELGIKISRHAKLCAR

SEQ ID NO: 10662 - protein, 46 aa, Homo Sapiens
MGKLVALVLLGVGLSLVGEMFLAFRVGFYLLQRKGECLSRSGASRT

SEQ ID NO: 10663 - protein, 46 aa, Homo Sapiens; identical to SEQ ID NO: 10662

SEQ ID NO: 10664 - protein, 808 aa, Homo Sapiens
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYTTKIITKVVEPKIKVIEGSLQPIIKTEGPTLTKVKIEGEPEFRLIKEGETITEVIHGEPIIKKYTKIIDGVPVEITEKETREERIITGPEIKYTRISTGGGETEETLKKLLQEDTPVRKLQANKKVQGSRRRLREGRSQ

SEQ ID NO: 10665 - protein, 779 aa, Homo Sapiens
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYKPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 10666 - protein, 809 aa, Homo Sapiens
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYRPTLTKVKIEGEPEFRLIKEGETITEVIHGEPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 10667 - protein, 836 aa, Homo Sapiens
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYTTKIITKVVEPKIKVIEGSLQPIIKTEGPTLTKVKIEGEPEFRLIKEGETITEVIHGEPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 10668 - protein, 781 aa, Homo Sapiens
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYRPTLTKVKIEGEPEFRLIKEGETITEVIHGEPIIKKYTKIIDGVPVEITEKETREERIITGPEIKYTRISTGGGETEETLKKLLQEDTPVRKLQANKKVQGSRRRLREGRSQ

SEQ ID NO: 10669 - protein, 749 aa, Homo Sapiens
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYSPEIKYTRISTGGGETEETLKKLLQEEVTKVTKFIEGGDGHLFEDEEIKRLLQGDTPVRKLQANKKVQGSRRRLREGRSQ

SEQ ID NO: 10670 - protein, 128 aa, Homo Sapiens
MSLRLDTTPSCNSARPLHALQVLLLLSLLLTALASSTKGQTKRNLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 10671 - protein, 216 aa, Homo Sapiens
MLRLSERNMKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 10672 - protein, 212 aa, Homo Sapiens
MGPGPRLLLPLVLCVGLGALVFSSGAEGFRKRGPSVTAKVFFDVRIGDKDVGRIVIGLFGKVVPKTVENFVALATGEKGYGYKGSKFHRVIKDFMIQGGDITTGDGTGGVSIYGETFPDENFKLKHYGIGWVSMANAGPDTNGSQFFITLTKPTWLDGKHVVFGKVIDGMTVVHSIELQATDGHDRPLTNCSIINSGKIDVKTPFVVEIADW

SEQ ID NO: 10673 - protein, 140 aa, Homo Sapiens
MGRTVVVLGGGISGLAASYHLSRAPCPPKVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 10674 - protein, 156 aa, Homo Sapiens
MGRTVVVLGGGISGLAASYHLSRAPCPPKVMLGGSWLQTLEASGCVLSQELFQQRAQEAAATQLGLKEMPSHCLVHLHKTKNQLKWRQSHDRTVEWPKEYPGRSRKQAPSILHVPGCQLLRCRDRDHLGAVSEQPRSSAESRVGVASSTFSTFPLF

SEQ ID NO: 10675 - protein, 78 aa, Homo Sapiens
MGRTVVVLGGGISGLAASYHLSRAPCPPKVVLVESSERLGGWIRSVRGPNGAIFELGPRGIRPAGALGARTLLLFLLF

SEQ ID NO: 10676 - protein, 185 aa, Homo Sapiens
MGRTVVVLGGGISGLAASYHLSRAPCPPKVVLVESSERLGGWIRSVRGPNGAIFELGPRGIRPAGALGARTLLLVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 10677 - protein, 188 aa, Homo Sapiens
MGRTVVVLGGGISGLAASYHLSRAPCPPKVVLVESSERLGGWIRSVRGPNGAIFELGPRGIRPAGALGARTLLLVMLGGSWLQTLEASGCVLSQELFQQRAQEAAATQLGLKEMPSHCLVHLHKTKNQLKWRQSHDRTVEWPKEYPGRSRKQAPSILHVPGCQLLRCRDRDHLGAVSEQPRSSAESRV

SEQ ID NO: 10678 - protein, 184 aa, Homo Sapiens
MGRTVVVLGGGISGLAASYHLSRAPCPPKVVLVESSERLGGWIRSVRGPNGAIFELGPRGIRPAGALGARTLLLVSELGLDSEVLPVRGDHPAAQNRFLYVGGALHALPTGLRGLLRPSPPFSKPLFWAGLRELTKPRGKEPDETVHSFAQRRLGPEGGPHSQTQHSFARPWLSAGASGHFVEV

SEQ ID NO: 10679 - protein, 477 aa, Homo Sapiens
MGRTVVVLGGGISGLAASYHLSRAPCPPKVVLVESSERLGGWIRSVRGPNGAIFELGPRGIRPAGALGARTLLLVSELGLDSEVLPVRGDHPAAQNRFLYVGGALHALPTGLRGLLRPSPPFSKPLFWAGLRELTKPRGKEPDETVHSFAQRRLGPEVASLAMDSLCRGVFAGNSRELSIRSCFPSLFQAEQTHRSILLGLLLGAGRTPQPDSALIRQALAERWSQWSLRGGLEMLPQALETHLTSRGVSVLRGQPVCGLSLQAEGRWKVSLRDSSLEADHVISAIPASVLSELLPAEAAPLARALSAITAVSVAVVNLQYQGAHLPVQGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 10680 - protein, 477 aa, Homo Sapiens; identical to SEQ ID NO: 10679

SEQ ID NO: 10681 - protein, 113 aa, Homo Sapiens
MGRTVVVLGGGISGLAASYHLSRAPCPPKVVLVESSERLGGWIRSVRGPNGAIFELGPRGIRPAGALGARTLLLVSLRDSSLEADHVISAIPASGIWTFGAIFRRSRSPGNRV

SEQ ID NO: 10682 - protein, 161 aa, Homo Sapiens
  misc_feature (1)..(1): Xaa can be any naturally occurring amino acid
XADHVISAIPASVLSELLPAEAAPLARALSAITAVSVAVVNLQYQGAHLPVQGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLGKLGKQLG

SEQ ID NO: 10683 - protein, 230 aa, Homo Sapiens
  misc_feature (1)..(1): Xaa can be any naturally occurring amino acid
XQAEQTHRSILLGLLLGAGRTPQPDSALIRQALAERWSQWSLRGGLEMLPQALETHLTSRGVSVLRGQPVCGLSLQAEGRWKGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 10684 - protein, 180 aa, Homo Sapiens [sequence omitted]

SEQ ID NO: 10685 - protein, 169 aa, Homo Sapiens
MRQRADRRSMVSTSGAATASSAAGPSRGAAHSPSSAPHASRHRPPFSSRATGLLQQRQHCVHHCTQLCPRVQTPCLPPPPAPATELHSYLQQGGERGLLDTTPVQGSRPGKNVQLTENEIRGLCLKSREIFLSQPILLELEAPLKICGDIHGQYYDLLRLFEYGGFPPE

SEQ ID NO: 10686 - protein, 286 aa, Homo Sapiens
MSDSEKLNLDSIIGRLLEGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 10687 - protein, 341 aa, Homo Sapiens
MSDSEKLNLDSIIGRLLEGSRVLTPHCAPVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 10688 - protein, 330 aa, Homo Sapiens
MSDSEKLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 10689 - protein, 253 aa, Homo Sapiens
MSDSEKLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDET

SEQ ID NO: 10690 - protein, 87 aa, Homo Sapiens
MALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 10691 - protein, 52 aa, Homo Sapiens
MASPGCLWLLAVALLPWTCASRALQHLDPPAPLPLVIWHGMASCKPNTGMTP

SEQ ID NO: 10692 - protein, 46 aa, Homo Sapiens
MASPGCLWLLAVALLPWTCASRALQHLDPPAPLPLVIWHGMAVAIP

SEQ ID NO: 10693 - protein, 46 aa, Homo Sapiens; identical to SEQ ID NO: 10692

SEQ ID NO: 10694 - protein, 305 aa, Homo Sapiens
MASPGCLWLLAVALLPWTCASRALQHLDPPAPLPLVIWHGMDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 10695 - protein, 282 aa, Homo Sapiens
MASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEDRLGLKEMDNAGQLVFLATEGDHLQLSEEWFYAHIIPFLG

SEQ ID NO: 10696 - protein, 306 aa, Homo Sapiens
MASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 10697 - protein, 301 aa, Homo Sapiens
MASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQFCSLPRLECNGMISAHCNLRLPGSSEFSCLSLPSS

SEQ ID NO: 10698 - protein, 306 aa, Homo Sapiens; identical to SEQ ID NO: 10696

SEQ ID NO: 10699 - protein, 148 aa, Homo Sapiens
MASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQVPCA

SEQ ID NO: 10700 - protein, 208 aa, Homo Sapiens
MASPGCLWLLAVALLPWTCASRALQHLDPPAPLPLVIWHGMGDSCCNPLSMGAIKKMVEKKIPGIYVLSLEIGKTLMEEGSGSEMPFTSHDQSDLGWGTTSSLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLAT

SEQ ID NO: 10701 - protein, 55 aa, Homo Sapiens
MASPGCLWLLAVALLPWTCASRALQHLDPPAPLPLVIWHGMGERQLLQSLKHGCY

SEQ ID NO: 10702 - protein, 335 aa, Homo Sapiens
MASPGCLWLLAVALLPWTCASRALQHLDPPAPLPLVIWHGMGSRYVAQTGLELLASSNPPASSYQSAGMIGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 10703 - protein, 203 aa, Homo Sapiens
MASPGCLWLLAVALLPWTCASRALQHLDPPAPLPLVIWHGMGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 10704 - protein, 35 aa, Homo Sapiens
  misc_feature (1)..(1): Xaa can be any naturally occurring amino acid
XLAVALLPWTCASRALQHLDPPAPLPLVIWHGMGE

SEQ ID NO: 10705 - protein, 323 aa, Homo Sapiens
  misc_feature (1)..(1): Xaa can be any naturally occurring amino acid
XLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQVTGRESILGGWCFFSSQFLKLLCSLVLEPFPLHLRALGPPGAKGNGQCRTASVSGYRRGPSSVV

SEQ ID NO: 10706 - protein, 78 aa, Homo Sapiens
  misc_feature (1)..(1): Xaa can be any naturally occurring amino acid
XPPMINLISVGGQHQGVFGLPRCPGESSHICDFIRKTLNAGAYSKVVQERGLDFTEVAKPRKPFPYRRPPCTHRTAWG

SEQ ID NO: 10707 - protein, 308 aa, Homo Sapiens
MKSCGSMLGLCGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 10708 - protein, 97 aa, Homo Sapiens
MLGLCGQRLPAAWVLLLLPFLPLLLLAAPAPHRASYKPVIVVHGLFDSSYSFRHLLEYINEGALCAGLCFLSWMITTWILSSPSPLHRWDSMETRTT

SEQ ID NO: 10709 - protein, 158 aa, Homo Sapiens
MLGLCGQRLPAAWVLLLLPFLPLLLLAAPAPHRASYKPVIVVHGLFDSSYSFRHLLEYINEMGQYGDTDYLKWLFPTSMRSNLYRICYSPWGQEFSICNYWHDPHHDDLYLNASSFLALINGERDHPNATVWRKNFLRVGHLVLIGGPDDGVITPWQS

SEQ ID NO: 10710 - protein, 180 aa, Homo Sapiens
MLGLCGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWH

SEQ ID NO: 10711 - protein, 302 aa, Homo Sapiens
MLGLCGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 10712 - protein, 302 aa, Homo Sapiens; identical to SEQ ID NO: 10711

SEQ ID NO: 10713 - protein, 302 aa, Homo Sapiens; identical to SEQ ID NO: 10711

SEQ ID NO: 10714 - protein, 302 aa, Homo Sapiens; identical to SEQ ID NO: 10711

SEQ ID NO: 10715 - protein, 79 aa, Homo Sapiens
MAAARLCLSLLLLSTCVALLLQPLLGAQGAPLEPVYPGDNATPEQMAQYAADLRRYINMLTRPRPRPMCPGQDGAYRQI

SEQ ID NO: 10716 - protein, 95 aa, Homo Sapiens
MAAARLCLSLLLLSTCVALLLQPLLGAQGAPLEPVYPGDNATPEQMAQYAADLRRYINMLTRPRYGKRHKEDTLAFSEWGSPHAAVPRELSPLDL

SEQ ID NO: 10717 - protein, 95 aa, Homo Sapiens; identical to SEQ ID NO: 10716

SEQ ID NO: 10718 - protein, 105 aa, Homo Sapiens
MAAARLCLSLLLLSTCVALLLQPLLGAQGAPLEPVYPGDNATPEQMAQYAADLRRYINMLTRPSACPCCLFPPRYGKRHKEDTLAFSEWGSPHAAVPRELSPLDL

SEQ ID NO: 10719 - protein, 132 aa, Homo Sapiens
  misc_feature (1)..(1): Xaa can be any naturally occurring amino acid
XQYAADLRRYINMLTRPRCVPQLGREIPAPGTLGPLHIPGHTLSPAPAPAPSRPALGKTGHLCSTGLDQCALGKMVPTGRYETGGLAPGHSACPCCLFPPRYGKRHKEDTLAFSEWGSPHAAVPRELSPLDL

SEQ ID NO: 10720 - protein, 90 aa, Homo Sapiens
MDRRRMALRPGSRRPTAFFFHSRWLVPNLLAFFLGLSGAGPIHLPMPWPNGRRHRVLDPHTQLSTHEAPGRWKPVAPRTMKACPQVLLEW

SEQ ID NO: 10721 - protein, 140 aa, Homo Sapiens
MEPQVRALRCGCWNRDSKRASGGSIQVNPKKSVCGGVHTTNYYGEEDKEDMDRRRMALRPGSRRPTAFFFHSRWLVPNLLAFFLGLSGAGPIHLPMPWPNGRRHRVLDPHTQLSTHEAPGRWKPVAPRTMKACPQVLLEW

SEQ ID NO: 10722 - protein, 188 aa, Homo Sapiens
MVPGAAGWCCLVLWLPACVAAHGFRIHDYLYFQVLSPGDIRYIFTATPAKDFGGIFHTRYEQIHLVPAEPPEACGELSNGFFIQDQIALVERGGCSFLSKTRVVQEHGGRAVIISDNAVDNDSFYVEMIQDSTQRTADIPALFLLGRDGYMIRRSLEQHGLPWAIISIPVNVTSIPTFELLQPPWTFW

SEQ ID NO: 10723 - protein, 151 aa, Homo Sapiens
MRRLLLVTSLVVVLLWEAGAVPAPKVPIKMQVKHWPSEQDPEKAWGARVVEPPEKDDQLVVLFPVQKPKLLTTEEKPRGQGRGPILPGTKAWMETEDTLGHVLSPEPDHDSLYHPPPEEDQGEERPRLWVMPNHQVLLGPEEDQDHIYHPQ

SEQ ID NO: 10724 - protein, 142 aa, Homo Sapiens
MRRLLLVTSLVVVLLWEAGAVPAPKVPIKMQVKHWPSEQDPEKAWGARVVEPPEKDDQLVVLFPVQKPKLLTTEEKPRGTKAWMETEDTLGHVLSPEPDHDSLYHPPPEEDQGEERPRLWVMPNHQVLLGPEEDQDHIYHPQ

SEQ ID NO: 10725 - protein, 178 aa, Homo Sapiens
MLLILLSVALLALSSAQNLNEDVSQEESPSLIAGNPQGPSPQGGNKPQGPPPPPGKPQGPPPQGGNKPQGPPPPGKPQGPPPQGDKSRSPRSPPGKPQGPPPQGGKPQGPPAQGGSKSQSARSPPGKPQGPPQQEGNNPQGPPPPAGGNPQQPQAPPAGQPQGPPRPPQGGRPSRPPQ

SEQ ID NO: 10726 - protein, 198 aa, Homo Sapiens
MLLILLSVALLALSSAQNLNEDVSQEESPSLIAGNPQGPSPQGGNKPQGPPPPPGKPQGPPPQGGNKPQGPPPPGKPQGPPPQGDKSRSPRSPPGKPQGPPPQGGKPQGPPPQGGNKPQGPPPPGKPQGPPAQGGSKSQSARSPPGKPQGPPQQEGNNPQGPPPPAGGNPQQPQAPPAGQPQGPPRPPQGGRPSRPPQ

SEQ ID NO: 10727 - protein, 151 aa, Homo Sapiens
MLLILLSVALLALSSAQNLNEDVSQEESPSLIAGNPQGPSPQGGNKPQGPPPPPGKPQGPPPQGGNKPQGPPPPGKPQGPPPQGDKSRSPRSPPGKPQGPPPQGGNQPQGPPPPPGKPQGPPPQGGNRPQGPPPPGKPQGPPPQGDKSRSP

SEQ ID NO: 10728 - protein, 330 aa, Homo Sapiens
MLLILLSVALLALSSAQNLNEDVSQEESPSLIAGNPQGPSPQGGNKPQGPPPPPGKPQGPPPQGGNKPQGPPPPGKPQGPPPQGDKSRSPRSPPGKPQGPPPQGGNQPQGPPPPPGKPQGPPPQGGNRPQGPPPPGKPQGPPPQGDKSRSPSPPGKPQGPPPQGGNQPQGPPPPPGKPQGPPPQGGKKPQGPPPPGKPQGPPPQGDKSRSSQSPPGKPQGPPPQGGNQPQGPPPPPGKPQGPPPQGGNKPQGPPPPGKPQGPPAQGGSKSQSARSPPGKPQGPPQQEGNNPQGPPPPAGGNPQQPQAPPAGQPQGPPRPPQGGRPSRPPQ

SEQ ID NO: 10729 - protein, 21 aa, Homo Sapiens
MLLILLSVALLALSSAQNLNE

SEQ ID NO: 10730 - protein, 416 aa, Homo Sapiens
MLLILLSVALLALSSAQNLNEDVSQEESPSLIAGNPQGAPPQGGNKPQGPPSPPGKPQGPPPQGGNQPQGPPPPPGKPQGPPPQGGNKPQGPPPPGKPQGPPPQGDKSRSPRSPPGKPQGPPPQGGNQPQGPPPPPGKPQGPPPQGGNKPQGPPPPGKPQGPPPQGDNKSRSSRSPPGKPQGPPPQGGNQPQGPPPPPGKPQGPPPQGGNKPQGPPPPGKPQGPPPQGDNKSQSARSPPGKPQGPPPQGGNQPQGPPPPPGKPQGPPPQGGNKPQGPPPPGKPQGPPPQGGSKSRSSRSPPGKPQGPPPQGGNQPQGPPPPPGKPQGPPPQGGNKPQGPPPPGKPQGPPPQGGSKSRSARSPPGKPQGPPQQEGNNPQGPPPPAGGNPQQPQAPPAGQPQGPPRPPQGGRPSRPPQ

SEQ ID NO: 10731 - protein, 351 aa, Homo Sapiens
MLLILLSVALLALSSAQSLNEDVSQEESPSVISGKPEGRRPQGGNQPQRTPPPPGKPEGRPPQGGNQSQGPPPRPGKPEGPPPQGGNQSQGPPPRPGKPEGQPPQGGNQSQGPPPRPGKPEGPPPQGGNQSQGPPPRPGKPEGPPPQGGNQSQGPPPRPGKPEGPPPQGGNQSQGPPPHPGKPEGPPPQGGNQSQGPPPRPGKPEGPPPQGGNQSQGPPPRPGKPEGPPPQGGNKPQGPPPRPGKPEGPPPQGGNQSQGPPPRPGKPEGPPSQGGNKPQGPPPHPGKPQGPPPQEGNKPQRPPPPGRPQGPPPPGGNPQQPLPPPAGKPQGPPPPPQGGRPHRPPQGQPPQ

SEQ ID NO: 10732 - protein, 309 aa, Homo Sapiens
MLLILLSVALLALSSAQSLNEDVSQEESPSVISGKPEGRRPQGGNQPQRTPPPPGKPEGRPPQGGNQSQGPPPRPGKPEGPPPQGGNQSQGPPPRPGKPEGQPPQGGNQSQGPPPRPGKPEGPPPQGGNQSQGPPPRPGKPEGPPPQGGNQSQGPPPRPGKPEGPPPQGGNQSQGPPPHPGKPEGPPPQGGNQSQGPPPRPGKPEGPPPQGGNQSQGPPPRPGKPEGPPSQGGNKPQGPPPHPGKPQGPPPQEGNKPQRPPPPGRPQGPPPPGGNPQQPLPPPAGKPQGPPPPPQGGRPHRPPQGQPPQ

SEQ ID NO: 10733 - protein, 178 aa, Homo Sapiens
MLLILLSVALLALSSAESSSEDVSQEESLFLISGKPEGRRPQGGNQPQRPPPPPGKPQGPPPQGGNQSQGPPPPPGKPEGRPPQGGNQSQGPPPHPGKPERPPPQGGNQSQGKPQGPPQQEGNKPQGPPPPGKPQGPPPAGGNPQQPQAPPAGKPQGPPPPPQGGRPPRPAQGQQPPQ

SEQ ID NO: 10734 - protein, 178 aa, Homo Sapiens; identical to SEQ ID NO: 10733

SEQ ID NO: 10735 - protein, 247 aa, Homo Sapiens
MLLILLSVALLALSSAESSSEDVSQEESLFLISGKPEGRRPQGGNQPQRPPPPPGKPQGPPPQGGNQSQGPPPPPGKPEGRPPQGGNQSQGPPPHPGKPERPPPQGGNQSQGTPPPPGKPERPPPQGGNQSHRPPPPPGKPERPPPQGGNQSQGPPPHPGKPEGPPPQEGNKSRSARSPPGKPQGPPQQEGNKPQGPPPPGKPQGPPPAGGNPQQPQAPPAGKPQGPPPPPQGGRPPRPAQGQQPPQ

SEQ ID NO: 10736 - protein, 247 aa, Homo Sapiens; identical to SEQ ID NO: 10735

SEQ ID NO: 10737 - protein, 54 aa, Homo Sapiens
MCTTLFLLSTLAMLWRRRFANRVQPEPSDVDGAARGSSLDADPQSSGREKEPLK

SEQ ID NO: 10738 - protein, 54 aa, Homo Sapiens; identical to SEQ ID NO: 10737

SEQ ID NO: 10739 - protein, 164 aa, Homo Sapiens [sequence omitted]

SEQ ID NO: 10740 - protein, 517 aa, Homo Sapiens
MGRRALLLLLLSFLAPWATIALRPALRALGSLHLPTNPTSLPAVAKNYSVLYFQQKALAAGQLHICIIQLNHYKTPLVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFSNGELDPWSGGGVTKDITDTLVAVTISEGAHHLDLRTKNALDPMSVLLARSLEVRHMKNWIRDFYDSAGKQH

SEQ ID NO: 10741 - protein, 496 aa, Homo Sapiens
MGRRALLLLLLSFLAPWATIALRPALRALGSLHLPTNPTSLPAVAKNYSVLYFQQKVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFSNGELDPWSGGGVTKDITDTLVAVTISEGAHHLDLRTKNALDPMSVLLARSLEVRHMKNWIRDFYDSAGKQH

SEQ ID NO: 10742 - protein, 116 aa, Homo Sapiens
MKVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAEN

SEQ ID NO: 10743 - protein, 26 aa, Homo Sapiens
MWDVAEELKAMLVFAEHRYYGESLPF

SEQ ID NO: 10744 - protein, 43 aa, Homo Sapiens
MWDVAEELKAMLVFAEHRYYGESLPFGDNSFKDSRHLNFLTSE

SEQ ID NO: 10745 - protein, 100 aa, Homo Sapiens
MWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAP

SEQ ID NO: 10746 - protein, 145 aa, Homo Sapiens
MWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNT

SEQ ID NO: 10747 - protein, 148 aa, Homo Sapiens
MWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSG

SEQ ID NO: 10748 - protein, 183 aa, Homo Sapiens
MWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAM

SEQ ID NO: 10749 - protein, 192 aa, Homo Sapiens
MWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNF

SEQ ID NO: 10750 - protein, 234 aa, Homo Sapiens
MWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSG

SEQ ID NO: 10751 - protein, 367 aa, Homo Sapiens
MMGSVLPAEALVLKTGLKAPGLALAEVITSDILHSFLYGRWRNVLGEQLFEDKSHHASPKTAFTAEVLAQSFSGEVQKLSSLVLPAEVIIAQSSIPGEGLGIFSKTWIKAGTEMGPFTGRVIAPEHVDICKNNNLMWEVFNEDGTVRYFIDASQEDHRSWMTYIKCARNEQEQNLEVVQIGTSIFYKAIEMIPPDQELLVWYGNSHNTFLGIPGVPGLEEDQKKNKHEDFHPADSAAGPAGRMRCVICHRGFNSRSNLRSHMRIHTLDKPFVCRFCNRRFSQSSTLRNHVRLHTGERPYKCQVCQSAYSQLAGLRAHQKSARHRPPSTALQAHSPALPAPHAHAPALAAAAAAAAAAAAHHLPAMVL

SEQ ID NO: 10752 - protein, 185 aa, Homo Sapiens
MDHRSRLRGTGLNRIPGTQSRAPRVPLPFHVQQEAREGEDWEREPPRQRPPIYEPPESEELPDNVMVSKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTL

SEQ ID NO: 10753 - protein, 271 aa, Homo Sapiens
MEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIIPDPAGKLKYFDKLN

SEQ ID NO: 10754 - protein, 186 aa, Homo Sapiens
MEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWSVSYTYIRRKKRMDLLLKHGQITLDMI

SEQ ID NO: 10755 - protein, 161 aa, Homo Sapiens
  misc_feature (1)..(1): Xaa can be any naturally occurring amino acid
XCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIKPEDTMKAWWPRESYNPRSSWKAEVFR

SEQ ID NO: 10756 - protein, 382 aa, Homo Sapiens
MRSPLCWLLPLLILASVAQGQPTRRPRPGTGPGRRPRPRPRPTPSFPQPDEPAEPTDLPPPLPPGPPSIFPDCPRECYCPPDFPSALYCDSRNLRKVPVIPPRIHYLYLQNNFITELPVESFQNATGLRWINLDNNRIRKIDQRVLEKLPGLVFLYMEKNQLEEVPSALPRNLEQLRLSQNHISRIPPGVFSKLENLLLLDLQHNRLSDGVFKPDTFHGLKNLMQLNLAHNILRKMPPRVPTAIHQLYLDSNKIETIPNGYFKSFPNLAFIRLNYNKLTDRGLPKNSFNISNLLVLHLSHNRISSVPAINNRLEHLYLNNNSIEKINGTQICPNDLVAFHDFSSDLENVPHLRYLRLDGNYLKPPIPLDLMMCFRLLQSVVI

SEQ ID NO: 10757 - protein, 555 aa, Homo Sapiens
MAARLLLLGILLLLLPLPVPAPCHTAARSECKRSHKFVPGAWLAGEGVDVTSLRRSGSFPVDTQRFLRPDGTCTLCENALQEGTLQRLPLALTNWRAQGSGCQRHVTRAKVSSTEAVARDAARSIRNDWKVGLDVTPKPTSNVHVSVAGSHSQAANFAAQKTHQDQYSFSTDTVECRFYSFHVVHTPPLHPDFKRALGDLPHHFNASTQPAYLRLISNYGTHFIRAVELGGRISALTALRTCELALEGLTDNEVEDCLTVEAQVNIGIHGSISAEAKACEEKKKKHKMTASFHQTYRERHSEVVGGHHTSINDLLFGIQAGPEQYSAWVNSLPGSPGLVDYTLEPLHVLLDSQDPRREALRRALSQYLTDRARWRDCSRPCPPGRQKSPRDPCQCVCHGSAVTTQDCCPRQRGLAQLEVTFIQAWGLWGDWFTATDAYVKLFFGGQELRTSTVWDNNNPIWSVRLDFGDVLLATGGPLRLQVWDQDSGRDDDLLGTCDQAPKSGSHEVRCNLNHGHLKFRYHARCLPHLGGGTCLDYVPQMLLGEPPGNRSGAVW

SEQ ID NO: 10758 - protein, 555 aa, Homo Sapiens; identical to SEQ ID NO: 10757

SEQ ID NO: 10759 - protein, 232 aa, Homo Sapiens
MAARLLLLGILLLLLPLPVPAPCHTAARSECKRSHKFVPGAWLAGEGVDVTSLRRSGSFPVDTQRFLRPDGTCTLCENALQEGTLQRLPLALTNWRAQGSGCQRHVTRAKVSSTEAVARDAARSIRNDWKVGLDVTPKPTSNVHVSVAGSHSQAANFAAQKTHQDQYSFSTDTVECRFYSSSAIVSASGFYMWPNTILLPTWPREAKRLDTHQTDGKGRFRLFFREVAGFTR

SEQ ID NO: 10760 - protein, 211 aa, Homo Sapiens
MKLPLLLALLFGAVSALHLRSETSTFETPLGAKTLPEDEETPEQEMEETPCRELEEEEEWGSGSEDASKKDGAVESISVPDMVDKNLTCPEEEDTVKVVGIPGCQTCRYLLFTCRRCYRGNLVSIHNFNINYRIQCSVSALNQGQVWIGGRITGSGRCRRFQWVDGSRWNFAYWAAHQPWSRGGHCVALCTRGGHWRRAHCLRRLPFICSY

SEQ ID NO: 10761 - protein, 222 aa, Homo Sapiens
MKLPLLLALLFGAVSALHLRSETSTFETPLGAKTLPEDEETPEQEMEETPCRELEEEEEWGSGSEDASKKDGAVESISVPDMVDKNLTCPEEEDTVKVVGIPGCQTCRYLLVRSLQTFSQAWFTCRRCYRGNLVSIHNFNINYRIQCSVSALNQGQVWIGGRITGSGRCRRFQWVDGSRWNFAYWAAHQPWSRGGHCVALCTRGGHWRRAHCLRRLPFICSY

SEQ ID NO: 10762 - protein, 222 aa, Homo Sapiens; identical to SEQ ID NO: 10761

SEQ ID NO: 10763 - protein, 225 aa, Homo Sapiens
MQCLLLLPFLLLGTVSALHLENDAPHLESLETQADLGQDLDSSKEQERDLALTEEVIQAEGEEVKASACQDNFEDEEAMESDPAALDKDFQCPREEDIVEVQGSPRCKICRYLLVRTPKTFAEAQNVCSRCYGGNLVSIHDFNFNYRIQCCTSTVNQAQVWIGGNLRGWFLWKRFCWTDGSHWNFAYWSPGQPGNGQGSCVALCTKGGYWRRAQCDKQLPFVCSF

SEQ ID NO: 10764 - protein, 1404 aa, Homo Sapiens
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIRKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTTPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 10765 - protein, 1361 aa, Homo Sapiens
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTTPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 10766 - protein, 1311 aa, Homo Sapiens
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTTPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 10767 - protein, 162 aa, Homo Sapiens
MAWKTLPIYLLLLLSVFVIQQVSSQELSCKGRCFESFERGRECDCDAQCKKYDKCCPDYESFCAEEHSVSENQESSSSSSSSSSSSTIRKIKSSKNSAANRELQKKLKVKDNKKNRTKKKPTPKPPVVDEAGSGLDNGDFKVTTPDTSTTQHNKVSTSPKIT

SEQ ID NO: 10768 - protein, 1363 aa, Homo Sapiens
MAWKTLPIYLLLLLSVFVIQQVSSQELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIRKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTTPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 10769 - protein, 854 aa, Homo Sapiens [sequence omitted]

SEQ ID NO: 10770 - protein, 140 aa, Homo Sapiens
GPPLGGQQSQPSAGDGNQDDGPQQGPPQQGGQQQQGPPPPQGKPQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 10771 - protein, 175 aa, Homo Sapiens
MLLILLSVALLAFSSAQDLNEDGGDSEQFLDEERQGPPLGGQQSQPSAGDGNQDDGPQQGPPQQGGQQQQGPPPPQGKPQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 10772 - protein, 187 aa, Homo Sapiens
MLLILLSVALLAFSSAQDLNEDVSQEDVPLVISDGGDSEQFLDEERQGPPLGGQQSQPSAGDGNQDDGPQQGPPQQGGQQQQGPPPPQGKPQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 10773 - protein, 166 aa, Homo Sapiens
MLLILLSVALLAFSSAQDLDEDVSQEDVPLVISDGGDSEQFIDEERQGPPLGGQQSQPSAGDGNQNDGPQQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 10774 - protein, 166 aa, Homo Sapiens; identical to SEQ ID NO: 10773

SEQ ID NO: 10775 - protein, 82 aa, Homo Sapiens
METVISSDSSPAVENEHPQETPESNNSVYTSFMKSHRCYDLIPTSSKLVVFDTSLQSCPCGFAFMIITVLATGEESFFCFGD

SEQ ID NO: 10776 - protein, 331 aa, Homo Sapiens
METVISSDSSPAVENEHPQETPESNNSVYTSFMKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 10777 - protein, 340 aa, Homo Sapiens
METVISSDSSPAVENEHPQETPESNNSVYTSFMKSHRCYDLIPTSSKLVVFDTSLQVKKAFFALVTNGVRAAPLWDSKKQSFVVLRALSCPLGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 10778 - protein, 43 aa, Homo Sapiens
MFSLTGVMVISSDSSPAVENEHPQETPESNNSVYTSFMKSHRC

SEQ ID NO: 10779 - protein, 69 aa, Homo Sapiens
MKSHRCYDLIPTSSKLVVFDTSLQVKKAFFALVTNGVRAAPLWDSKKQSFVGMLTITDFINILHRYYKS

SEQ ID NO: 10780 - protein, 82 aa, Homo Sapiens
MKSHRCYDLIPTSSKLVVFDTSLQVKKAFFALVTNGVRAAPLWDSKKQSFVGMLTITDFINILHRYYKSALVQIYELEEHKI

SEQ ID NO: 10781 - protein, 125 aa, Homo Sapiens
MKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVID

SEQ ID NO: 10782 - protein, 161 aa, Homo Sapiens
MKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSL

SEQ ID NO: 10783 - protein, 299 aa, Homo Sapiens
MKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 10784 - protein, 28 aa, Homo Sapiens
MLTITDFINILHRYYKSALVQIYELEEH

SEQ ID NO: 10785 - protein, 145 aa, Homo Sapiens
MLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALP

SEQ ID NO: 10786 - protein, 203 aa, Homo Sapiens [sequence omitted]

SEQ ID NO: 10787 - protein, 280 aa, Homo Sapiens
MSILKVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 10788 - protein, 251 aa, Homo Sapiens
NSVYTSFMKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNARSLSSPSQSSCPSLWKSYRLAPMPILLWFALPPPSMWLWGFLYSIESQPCQWWMRRNLAAEKTYNNLDVSVTKALQHRSHYFEGVLKCYLHETLETIINRLVEAEVHRLVVVDENDVVKGIVSLSDILQALVLTGGEKKP

SEQ ID NO: 10789 - protein, 93 aa, Homo Sapiens
RVVDIYSKFDVINLAAEKTYNNLDVSVTKALQHRSHYFEGVLKCYLHETLETIINRLVEAEVHRLVVVDENDVVKGICPTHCLLEALWESDET

SEQ ID NO: 10790 - protein, 200 aa, Homo Sapiens
AEEEEEEEDSEVQGEQPKPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTEPSRCEYLMELMTPAACPEPPPEAPTEDDHDEL

SEQ ID NO: 10791 - protein, 62 aa, Homo Sapiens
MLLPLLLLLPMCWAVEVKRPRGVSLTNHHFYDESKPFTCLDGSATIPFDQVNDDYCDCKDGS

SEQ ID NO: 10792 - protein, 140 aa, Homo Sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRL

SEQ ID NO: 10793 - protein, 144 aa, Homo Sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKIL

SEQ ID NO: 10794 - protein, 168 aa, Homo Sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKS

SEQ ID NO: 10795 - protein, 535 aa, Homo Sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEVQGEQPKEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTEPSRCEYLMELMTPAACPEPPPEAPTEDDHDEL

SEQ ID NO: 10796 - protein, 528 aa, Homo Sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTEPSRCEYLMELMTPAACPEPPPEAPTEDDHDEL

SEQ ID NO: 10797 - protein, 525 aa, Homo Sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEVQGEQPKPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTEPSRCEYLMELMTPAACPEPPPEAPTEDDHDEL

SEQ ID NO: 10798 - protein, 525 aa, Homo Sapiens; identical to SEQ ID NO: 10797

SEQ ID NO: 10799 - protein, 132 aa, Homo Sapiens
MLLPLLLLLPMCWAVEVKRPRGVSLTSESSCSPSRQAGGGRGQHWALGIGIYSLLTQFPGSAPLVGMGGQRWYLVEKALTCPGLSFLYPADHHFYDESKPFTCLDGSATIPFDQVNDDYCDCKDGSDEPGTA

SEQ ID NO: 10800 - protein, 80 aa, Homo Sapiens
EVLRNKGYNRSLDMWSVGVIIYVSLSGTFPFNEDEDIHDQIQNAAFMYPPNPWKEISHEDVDLIQYNTYILGCLSSHCTA

SEQ ID NO: 10801 - protein, 117 aa, Homo Sapiens
MILSPPQPCGTFPECGFYGMYDKILLFRHDPTSENILQLVKAASDIQEGDLIEVVLSASATFEDFQIRPHALFVHSYRAPAFCDHCGEMLWGLVRQGLKCEGCGLNYHKRCAFKIPN

SEQ ID NO: 10802 - protein, 912 aa, Homo Sapiens
MSAPPVLRPPSPLLPVAAAAAAAAAALVPGSGPGPAPFLAPVAAPVGGISFHLQIGLSREPVLLLQDSSGDYSLAHVREMACSIVDQKFPECGFYGMYDKILLFRHDPTSENILQLVKAASDIQEGDLIEVVLSASATFEDFQIRPHALFVHSYRAPAFCDHCGEMLWGLVRQGLKCEGCGLNYHKRCAFKIPNNCSGVRRRRLSNVSLTGVSTIRTSSAELSTSAPDEPLLQKSPSESFIGREKRSNSQSYIGRPIHLDKILMSKVKVPHTFVIHSYTRPTVCQYCKKLLKGLFRQGLQCKDCRFNCHKRCAPKVPNNCLGEVTINGDLLSPGAESDVVMEEGSDDNDSERNSGLMDDMEEAMVQDAEMAMAECQNDSGEMQDPDPDHEDANRTISPSTSNNIPLMRVVQSVKHTKRKSSTVMKEGWMVHYTSKDTLRKRHYWRLDSKCITLFQNDTGSRYYKEIPLSEILSLEPVKTSALIPNGANPHCFEITTANVVYYVGENVVNPSSPSPNNSVLTSGVGADVARMWEIAIQHALMPVIPKGSSVGTGTNLHRDISVSISVSNCQIQENVDISTVYQIFPDEVLGSGQFGIVYGGKHRKTGRDVAIKIIDKLRFPTKQESQLRNEVAILQNLHHPGVVNLECMFETPERVFVVMEKLHGDMLEMILSSEKGRLPEHITKFLITQILVALRHLHFKNIVHCDLKPENVLLASADPFPQVKLCDFGFARIIGEKSFRRSVVGTPAYLAPEVLRNKGYNRSLDMWSVGVIIYVSLSGTFPFNEDEDIHDQIQNAAFMYPPNPWKEISHEAIDLINNLLQVKMRKRYSVDKTLSHPWLQDYQTWLDLRELECKIGERYITHESDDLRWEKYAGEQGLQYPTHLINPSASHSDTPETEETEMKALGERVSIL

SEQ ID NO: 10803 - protein, 912 aa, Homo Sapiens; identical to SEQ ID NO: 10802

SEQ ID NO: 10804 - protein, 920 aa, Homo Sapiens
MSAPPVLRPPSPLLPVAAAAAAAAAALVPGSGPGPAPFLAPVAAPVGGISFHLQIGLSREPVLLLQDSSGDYSLAHVREMACSIVDQKFPECGFYGMYDKILLFRHDPTSENILQLVKAASDIQEGDLIEVVLSASATFEDFQIRPHALFVHSYRAPAFCDHCGEMLWGLVRQGLKCEGCGLNYHKRCAFKIPNNCSGVRRRRLSNVSLTGVSTIRTSSAELSTSAPDEPLLSPVSPGFEQKSPSESFIGREKRSNSQSYIGRPIHLDKILMSKVKVPHTFVIHSYTRPTVCQYCKKLLKGLFRQGLQCKDCRFNCHKRCAPKVPNNCLGEVTINGDLLSPGAESDVVMEEGSDDNDSERNSGLMDDMEEAMVQDAEMAMAECQNDSGEMQDPDPDHEDANRTISPSTSNNIPLMRVVQSVKHTKRKSSTVMKEGWMVHYTSKDTLRKRHYWRLDSKCITLFQNDTGSRYYKEIPLSEILSLEPVKTSALIPNGANPHCFEITTANVVYYVGENVVNPSSPSPNNSVLTSGVGADVARMWEIAIQHALMPVIPKGSSVGTGTNLHRDISVSISVSNCQIQENVDISTVYQIFPDEVLGSGQFGIVYGGKHRKTGRDVAIKIIDKLRFPTKQESQLRNEVAILQNLHHPGVVNLECMFETPERVFVVMEKLHGDMLEMILSSEKGRLPEHITKFLITQILVALRHLHFKNIVHCDLKPENVLLASADPFPQVKLCDFGFARIIGEKSFRRSVVGTPAYLAPEVLRNKGYNRSLDMWSVGVIIYVSLSGTFPFNEDEDIHDQIQNAAFMYPPNPWKEISHEAIDLINNLLQVKMRKRYSVDKTLSHPWLQDYQTWLDLRELECKIGERYITHESDDLRWEKYAGEQGLQYPTHLINPSASHSDTPETEETEMKALGERVSIL

SEQ ID NO: 10805 - protein, 157 aa, Homo Sapiens
SSTVMKEGWMVHYTSKDTLRKRHYWRLDSKCITLFQNDTGSRYYKEIPLSEILSLEPVKTSALIPNGANPHCFEITTANVVYYVGENVVNPSSPSPNNSVLTSGVGADVARMWEIAIQHALMPVIPKGSSVGTGTNLHSESASFLTSPKLIMCLPLA

SEQ ID NO: 10806 - protein, 228 aa, Homo Sapiens
MNIKGSPWKAGSLLLLLVSNLLLCQSVAPLPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 10807 - protein, 227 aa, Homo Sapiens
MNIKGSPWKGSLLLLLVSNLLLCQSVAPLPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 10808 - protein, 196 aa, Homo Sapiens
MNIKGSPWKGSLLLLLVSNLLLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 10809 - protein, 87 aa, Homo Sapiens
MKVLRAWLLCLLMLGLALRGAASRTHRHSMEIRTPDINPAWYASRGIRPVGRFGRRRATLGDVPKPGLRPRLTCFPLEGGAMSSQDG

SEQ ID NO: 10810 - protein, 33 aa, Homo Sapiens
MKENVASATVFTLLLFLNTCLLNDPFCWAANRV

SEQ ID NO: 10811 - protein, 34 aa, Homo Sapiens
MKENVASATVFTLLLFLNTCLLNERHSCMNVQTT

SEQ ID NO: 10812 - protein, 34 aa, Homo Sapiens; identical to SEQ ID NO: 10811

SEQ ID NO: 10813 - protein, 34 aa, Homo Sapiens
MKENVASATVFTLLLFLNTCLLNGQLPPGKPEIF

SEQ ID NO: 10814 - protein, 62 aa, Homo Sapiens
MKENVASATVFTLLLFLNTCLLNGQLPPGKPEIFKCRSPNKETFTCWWRPGTDGGLPTNYSL

SEQ ID NO: 10815 - protein, 103 aa, Homo Sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMV

SEQ ID NO: 10816 - protein, 111 aa, Homo Sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGS

SEQ ID NO: 10817 - protein, 120 aa, Homo Sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVD

SEQ ID NO: 10818 - protein, 376 aa, Homo Sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGDPLMLGASHYKNLKSYRPRKISSQGRLAVFTKATLTTVQ

SEQ ID NO: 10819 - protein, 349 aa, Homo Sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQEREQRQAQEARDS

SEQ ID NO: 10820 - protein, 288 aa, Homo Sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEVTP

SEQ ID NO: 10821 - protein, 622 aa, Homo Sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 10822 - protein, 288 aa, Homo Sapiens; identical to SEQ ID NO: 10820

SEQ ID NO: 10823 - protein, 376 aa, Homo Sapiens; identical to SEQ ID NO: 10818

SEQ ID NO: 10824 - protein, 349 aa, Homo Sapiens; identical to SEQ ID NO: 10819

SEQ ID NO: 10825 - protein, 268 aa, Homo Sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSGDPLMLGASHYKNLKSYRPRKISSQGRLAVFTKATLTTVQ

SEQ ID NO: 10826 - protein, 268 aa, Homo Sapiens; identical to SEQ ID NO: 10825

SEQ ID NO: 10827 - protein, 521 aa, Homo Sapiens
MKENVASATVFTLLLFLNTCLLNVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 10828 - protein, 521 aa, Homo Sapiens; identical to SEQ ID NO: 10827

SEQ ID NO: 10829 - protein, 217 aa, Homo Sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQ

SEQ ID NO: 10830 - protein, 249 aa, Homo Sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIF

SEQ ID NO: 10831 - protein, 253 aa, Homo Sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 10832 - protein, 253 aa, Homo Sapiens; identical to SEQ ID NO: 10831

SEQ ID NO: 10833 - protein, 94 aa, Homo Sapiens
MQHSLVFFFAVILHLSHLLHLDASIHPFRLPFSSKPFLLIPMSNTTLPHTAWPLSFLHQTVSTLKAVAVTHSLWHLQIPVDCQACNRKSKKIYC

SEQ ID NO: 10834 - protein, 116 aa, Homo Sapiens
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIG

SEQ ID NO: 10835 - protein, 126 aa, Homo Sapiens
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGW

SEQ ID NO: 10836 - protein, 175 aa, Homo Sapiens
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQREEVGWRRCSCAPGYKLGDDLLQCHPAVKFPCGRPWKRMEKKR

SEQ ID NO: 10837 - protein, 461 aa, Homo Sapiens
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQREVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 10838 - protein, 495 aa, Homo Sapiens
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQRGEGERWMLAGGGAGLGPGWGRGTSTSCPRPPLPAEVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 10839 - protein, 52 aa, Homo Sapiens
MWQLTSLLLFVATWGISGTPAPLGAADPQTCQLLPGGAPSQQPGAGVHRGDL

SEQ ID NO: 10840 - protein, 52 aa, Homo Sapiens; identical to SEQ ID NO: 10839

SEQ ID NO: 10841 - protein, 236 aa, Homo Sapiens
  misc_feature (1)..(1): Xaa can be any naturally occurring amino acid
XCSLDNGGCTHYCLEEVGWRRCSCAPGYKLGDDLLQCHPAGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 10842 - protein, 105 aa, Homo Sapiens
MRGATRVSIMLLLVTVSDCAVITGACERDVQCGAGTCCAISLWLRGLRMCTPLGREGEECHPGSHKVPFFRKRKHHTCPCLPNLLCSRFPDGRYRCSMDLKNINF

SEQ ID NO: 10843 - protein, 129 aa, Homo Sapiens
MRSLCCAPLLLLLLLPPLLLTPRAGDAAVITGACDKDSQCGGGMCCAVSIWVKSIRICTPMGKLGDSCHPLTRKNNFGNGRQERRKRKRSKRKKEVPFFGRRMHHTCPCLPGLACLRTSFNRFICLAQK

SEQ ID NO: 10844 - protein, 108 aa, Homo Sapiens
MRSLCCAPLLLLLLLPPLLLTPRAGDAAVITGACDKDSQCGGGMCCAVSIWVKSIRICTPMGKLGDSCHPLTRKVPFFGRRMHHTCPCLPGLACLRTSFNRFICLAQK

SEQ ID NO: 10845 - protein, 14 aa, Homo Sapiens
MALVLGSLLLLGLC

SEQ ID NO: 10846 - protein, 40 aa, Homo Sapiens
MALVLGSLLLLGLCGNSFSGGQPSSTDAPKAWNYELPATN

SEQ ID NO: 10847 - protein, 58 aa, Homo Sapiens
MALVLGSLLLLGLCGNSFSGGQPSSTDAPKAWNYELPATNYETQDSHKAGPIGILFEL

SEQ ID NO: 10848 - protein, 856 aa, Homo Sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 10849 - protein, 856 aa, Homo Sapiens; identical to SEQ ID NO: 10848

SEQ ID NO: 10850 - protein, 865 aa, Homo Sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 10851 - protein, 865 aa, Homo Sapiens; identical to SEQ ID NO: 10850

SEQ ID NO: 10852 - protein, 834 aa, Homo Sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDPSQH

SEQ ID NO: 10853 - protein, 842 aa, Homo Sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNPSQH

SEQ ID NO: 10854 - protein, 93 aa, Homo Sapiens
  misc_feature (1)..(1): Xaa can be any naturally occurring amino acid
XEHYLQWIEFSISEKVASCKPVATALDTAVDVFLCSYIIDPLNLFWFGIGKATVFLLPALIFAVKLAKYYRRMDSEDVYDDVETIPMKNPSQH

SEQ ID NO: 10855 - protein, 54 aa, Homo Sapiens
  misc_feature (1)..(1): Xaa can be any naturally occurring amino acid
XQDSHKAGPIGILFELVHIFLYVVQPRDFPEDENTKAQIGEACSFKTLQPNESW

SEQ ID NO: 10856 - protein, 65 aa, Homo Sapiens
  misc_feature (1)..(1): Xaa can be any naturally occurring amino acid
XVDVFLCSYIIDPLNLFWFGIGKATVFLLPALIFAVKLAKYYRRMDSEDVYDDVETIPMKNPSQH

SEQ ID NO: 10857 - protein, 231 aa, Homo Sapiens
MRVLGGRCGALLACLLLVLPVSEANFCLYFRNDFIYNRACISVLVGLSGCNFFYSICFLSKQQASQVLVRKRRANSLLEETKQGNLERECIEELCNKEEAREVFENDPETDYFYPKYLVCLRSFQTGLFTAARQSTNAYPDLRSCVNAIPDQCSPLPCNEDGYMSCKDGKASFTCTCKPGWQGEKCEFDINECKDPSNINGGCSQICDNTPGSYHCSCKNGFVMLSNKKDC

SEQ ID NO: 10858 - protein, 676 aa, Homo Sapiens
MRVLGGRCGALLACLLLVLPVSEANFLSKQQASQVLVRKRRANSLLEETKQGNLERECIEELCNKEEAREVFENDPETDYFYPKYLVCLRSFQTGLFTAARQSTNAYPDLRSCVNAIPDQCSPLPCNEDGYMSCKDGKASFTCTCKPGWQGEKCEFDINECKDPSNINGGCSQICDNTPGSYHCSCKNGFVMLSNKKDCKDVDECSLKPSICGTAVCKNIPGDFECECPEGYRYNLKSKSCEDIDECSENMCAQLCVNYPGGYTCYCDGKKGFKLAQDQKSCEVVSVCLPLNLDTKYELLYLAEQFAGVVLYLKFRLPEISRFSAEFDFRTYDSEGVILYAESIDHSAWLLIALRGGKIEVQLKNEHTSKITTGGDVINNGLWNMVSVEELEHSISIKIAKEAVMDINKPGPLFKPENGLLETKVYFAGFPRKVESELIKPINPRLDGCIRSWNLMKQGASGIKEIIQEKQNKHCLVTVEKGSYYPGSGIAQFHIDYNNVSSAEGWHVNVTLNIRPSTGTGVMLALVSGNNTVPFAVSLVDSTSEKSQDILLSVENTVIYRIQALSLCSDQQSHLEFRVNRNNLELSTPLKIETISHEDLQRQLAVLDKAMKAKVATYLGGLPDVPFSATPVNAFYNGCMEVNINGVQLDLDEAISKHNDIRAHSCPSVWKKTKNS

SEQ ID NO: 10859 - protein, 56 aa, Homo Sapiens
MSCKDGKASFTCTCKPGWQGEKCEFDINECKDPSNINGGCSQICDNTPGSYHCSCK

SEQ ID NO: 10860 - protein, 545 aa, Homo Sapiens
MSCKDGKASFTCTCKPGWQGEKCEFDINECKDPSNINGGCSQICDNTPGSYHCSCKNGFVMLSNKKDCKDVDECSLKPSICGTAVCKNIPGDFECECPEGYRYNLKSKSCEDIDECSENMCAQLCVNYPGGYTCYCDGKKGFKLAQDQKSCEVVSVCLPLNLDTKYELLYLAEQFAGVVLYLKFRLPEISRFSAEFDFRTYDSEGVILYAESIDHSAWLLIALRGGKIEVQLKNEHTSKITTGGDVINNGLWNMVSVEELEHSISIKIAKEAVMDINKPGPLFKPENGLLETKVYFAGFPRKVESELIKPINPRLDGCIRSWNLMKQGASGIKEIIQEKQNKHCLVTVEKGSYYPGSGIAQFHIDYNNVSSAEGWHVNVTLNIRPSTGTGVMLALVSGNNTVPFAVSLVDSTSEKSQDILLSVENTVIYRIQALSLCSDQQSHLEFRVNRNNLELSTPLKIETISHEDLQRQLAVLDKAMKAKVATYLGGLPDVPFSATPVNAFYNGCMEVNINGVQLDLDEAISKHNDIRAHSCPSVWKKTKNS

SEQ ID NO: 10861 - protein, 422 aa, Homo Sapiens
MAGCVPLLQGLVLVLALHRVEPSATSLKERHGLHSDSACTGVQESLFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQVKLTNSEGKDFCGGVIIRENFVLTTAKCSLLHRNITVKTYFNRTSQDPLMIKITHVHVHMRYDADAGENDLSLLELEWPIQCPGAGLPVCTPEKDFAEHLLIPRTRGLLSGWARNGTDLGNSLTTRPVTLVEGEECGQVLNVTVTTRTYCERSSVAAMHWMDGSVVTREHRGSWFLTGVLGSQPVGGQAHMVLVTKVSRYSLWFKQIMN

SEQ ID NO: 10862 - protein, 400 aa, Homo Sapiens
MAGCVPLLQGLVLVLALHRVEPSVFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQVKLTNSEGKDFCGGVIIRENFVLTTAKCSLLHRNITVKTYFNRTSQDPLMIKITHVHVHMRYDADAGENDLSLLELEWPIQCPGAGLPVCTPEKDFAEHLLIPRTRGLLSGWARNGTDLGNSLTTRPVTLVEGEECGQVLNVTVTTRTYCERSSVAAMHWMDGSVVTREHRGSWFLTGVLGSQPVGGQAHMVLVTKVSRYSLWFKQIMN

SEQ ID NO: 10863 - protein, 26 aa, Homo Sapiens
MKLLLWACIVCVAFARKNAGLGFLWL

SEQ ID NO: 10864 - protein, 219 aa, Homo Sapiens
MKLLLWACIVCVAFARKRRFPFIGEDDNDDGHPLHPSLNIPYGIRNLPPPLYYRPVNTVPSYPGNTYTDTGLPSYPWILTSPGFPYVYHIRGFPLATQLNVPPLPPRGFPFVPPSRFFSAAAAPAAPPIAAEPAAAAPLTATPVAAEPAAGAPVAAEPAAEAPVGAEPAAEAPVAAEPAAEAPVGVEPAAEEPSPAEPATAKPAAPEPHPSPSLEQANQ

SEQ ID NO: 10865 - protein, 219 aa, Homo Sapiens; identical to SEQ ID NO: 10864

SEQ ID NO: 10866 - protein, 61 aa, Homo Sapiens
  misc_feature (1)..(1): Xaa can be any naturally occurring amino acid
XAEAPVGAEPAAEAPVAAEPAAEAPVGVEPAAEEPSPAEPATAKPAAPEPHPSPSLEQANQ

SEQ ID NO: 10867 - protein, 65 aa, Homo Sapiens
MLLVLLSVVLLALSSAQSTDNDVNYEDFTFTIPACRKHHHSSRGTDQQDIPRSNHSGNLEFSGRK

SEQ ID NO: 10868 - protein, 78 aa, Homo Sapiens
MLLVLLSVVLLALSSAQSTDNDVNYEDFTFTIPATTTPTRTPSTLSTPISFCQPAGSIIILPEGQTSKTSPGATTLVI

SEQ ID NO: 10869 - protein, 134 aa, Homo Sapiens
MLLVLLSVVLLALSSAQSTDNDVNYEDFTFTIPDVEDSSQRPDQGPQRPPPEGLLPRPPGDSGNQDDGPQQRPPKPGGHHRHPPPPPFQNQQRPPRRGHRQLSLPRFPSVSLQEASSFFQRDRPARHPQEQPLW

SEQ ID NO: 10870 - protein, 98 aa, Homo Sapiens
MRGHPSLLLLYMALTTCLDTSPSEETDQEVFLGPPEAQSFLSSHTRIPRANHWDLELLTPGNLERECLEERCSWEEAREYFEDNTLTERFWESYIYNG

SEQ ID NO: 10871 - protein, 202 aa, Homo Sapiens
MRGHPSLLLLYMALTTCLDTSPSEETDQEVFLGPPEAQSFLSSHTRIPRANHWDLELLTPGNLERECLEERCSWEEAREYFEDNTLTERFWESYIYNGKGGRGRVDVASLAVGLTGGILLIVLAGLGAFWYLRWRQHRGQQPCPQEAGLISPLSPLNPLGPPTPLPPPPPPPPGLPTYEQALAASGVHDAPPPPYTSLRRPH

SEQ ID NO: 10872 - protein, 96 aa, Homo Sapiens
MRGHPSLLLLYMALTTCLDTSPSEETDQVLPLPGVQDPAPSSFRPRNLDSQPLLLPPGPHCFPSPYDSSPRDPPFFCPSCLWVQKSSWVPQRPRAS

SEQ ID NO: 10873 - protein, 981 aa, Homo Sapiens
MASSPWGCVCGLLLLLLPLLGTGPALGRGFPRPLENSEIPMIPGAHPKGSVGSEPQAFDVFPENPRADSHRNSDVRHAPAEEMPEKPVASPLGPALYGPKAAQGAQRERLPVTDDLQMAQGPSSHGWTGPLDSQELLQQEAVAPHPVGHPHLTFIPTTPRRQLRVATVPPSLQHEGQEGQWPPRDEGLKAKTKSRVPPTSPSDHQGPPHTLVSHSGTVKRPVLEGQGGFEEHLQEAAQGPHFTQQDPAAPDVGSVPPVEVVYSQEPGAQPDLALARSLPPAEELPVETPKRAGAEVSWEVSSPGPPPKQADLPDAKDSPGPQPTDPPASEAPDRPSKPERAAMNGADPISPQRVRGAVEAPGTPKSLIPGPSDPGPAVNRTESPMGALQPDEAEEWPGRPQSHPPAPPVQAPSTSRRGLIRVTTQRALGQPPPPEPTASSMASAPASSPPANATAPPLRWGPLRRVLSFSWELHVYGVGVLFLLPALLALAALAAAPAGPRLALVAAVLVLVASALRSAYMLTDPYGSQARLGVRGGLVLYNLPFPLLLTALAALTLLGLGAGLPPPLQNPLLLGAVALVHGVGLLATDLLSTWSVLNLLTQGLSCAWGAAVALGTLCLCRRRLLDGPRGWDASPGPRLLAVAGALGLLASGLQLAAALWLYPGPGRVGRFSWAWWGVHFWLRLLELTWALALALAAVAAARPRPPTEHACWAKLMRLACPAPSGKSEVPERPNNCYAGPSNVGAGSLDISKSLIRNPAESGQLATPSSGAWGSAASLGRGPQGGPGLSRNGVGPAPSLSELDLRPPSPINLSRSIDAALFREHLVRDSVFQRCGLRGLASPPPGGALRPRRGSHPKAELDDAGSSLLRGRCRSLSDVRVRGPVPQHVVEAPDGAAAAASGSSLDSFSRGSLKISWNPWRHGLSSVDSLPLDELPSTVQLLPAPTPAPDSTAARQGDGQGEVQPRGKPGESRSASSDTIEL

SEQ ID NO: 10874 - protein, 981 aa, Homo Sapiens; identical to SEQ ID NO: 10873

SEQ ID NO: 10875 - protein, 421 aa, Homo Sapiens
MASSPWGCVCGLLLLLLPLLGTGPALGRGFPRPLENSEIPMIPGAHPKGSVGSEPQAFDVFPENPRADSHRNSDVRHAPAEEMPEKPVASPLGPALYGPKAAQGAQRERLPVTDDLQMAQGPSSHGWTGPLDSQELLQQEAVAPHPVGHPHLTFIPTTPRRQLRVATVPPSLQHEGQEGQWPPRDEGLKAKTKSRVPPTSPSDHQGPPHTLVSHSGTVKRPVLEGQGGFEEHLQEAAQGPHFTQQDPAAPDVGSVPPVEVVYSQEPGAQPDLALARSLPPAEELPVETPKRAGAEVSWEVSSPGPPPKQADLPDAKDSPGPQPTDPPASEAPDRPSKPERAAMNGADPISPQRVRGAVEAPGTPKSLIPGPSDPGPAVNRTESPMGALQPGESMAGVWGEGVLCLVTENLCWGCMGAEGGE

SEQ ID NO: 10876 - protein, 205 aa, Homo Sapiens
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRA

SEQ ID NO: 10877 - protein, 208 aa, Homo Sapiens
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLA

SEQ ID NO: 10878 - protein, 899 aa, Homo Sapiens
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGVGALFGLVALLALLALALLPWRCPPGAPCLALLDLLLLSAGTTRAFPLFYDAYGHRDRLPALAWLLLQDLPLPCLAAGLGLACLLLARPRPPRCPTGLAALLLLGLGLAAAAALGSAAHRPLRPLRLASRGLHAFLAAFLSGLLLALSCWGGRRRRAGAPLGGSGFKGATPLPQGRSPFAPRESWRRAARTAPVAGTFGLLSGALQGYEVLHALGYGGQSGLEGPWPWWAFQLGLRLGEVGVALPLALLGLYPALCSPRVPPRCWAKLFRLSPGHAAPLLPGGWVTGPPDKEPLGSAIARGDAELLQLCALAGPGPDLLLQGGGCRGFEGAAANPAPSPASSPCSDYTVDFRPPSPINLRRSIEEALCSEALLAPGLFQGPAFEDALPGLGLYRTASLGTGGRASERSGEASGPAAPPELPSPGAWPAGSSVSSGSFCGLSRDSSSMLLCSSPDRPPRCPLVCVLSPPRPSGSSPSLPASGSYQALSPPSRDSPEPASELQAEEALLQEQFLDACRQIDELSVGSDTIDL

SEQ ID NO: 10879 - protein, 899 aa, Homo Sapiens; identical to SEQ ID NO: 10878

SEQ ID NO: 10880 - protein, 480 aa, Homo Sapiens
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGVGALFGLVALLALLALALLPWRCPPGAPCLALLDLLLLSAGTTRAFPLFYDAYGHRDRLPALAWLLLQDLPLPCLAAGLGLACLLLARPRPPRCPTGLAALLLLGLGLAAA

SEQ ID NO: 10881 - protein, 429 aa, Homo Sapiens
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGRLHRGLPPALPNQPATQHRGGPLQRGPACAWPLPGPCLRGRSAWARTLPHRLAGDRGQGQ

SEQ ID NO: 10882 - protein, 419 aa, Homo Sapiens
  misc_feature (1)..(1): Xaa can be any naturally occurring amino acid
XSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPILACRRAAGPSSSACPRATRLRCCREAGSLGPQTRSPWGAPSLAGTRSCCSCARWQGQAQTSYSRAEVAGASKARRPTRPRPRLPLPAAITPWTSARPPQSTCDAASRRPSAARPCLRLASSRALPSRTLCLGSDSTAPPRWGPGAGPVRDQGRPLAPLRPRSSPPLGLGPQAAASHLARSADSRGTARPCCCVPAPTGPRAALWSASSVPRGPQEAAPASRPQDPTRPCPHPLATPQSLLLSCRPRRPCCRSSSWTPADRSTS

SEQ ID NO: 10883 - protein, 261 aa, Homo Sapiens
MNPLLILTFVAAALAAPFDDDDKIVGGYNCEENSVPYQVSLNSGYHFCGGSLINEQWVVSAGHCYKSAIKSKFSGRGCEYHRIQVRLGEHNIEVLEGNEQFINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGGKDSCQGDSGGPVVCNGQLQGVVSWGDGCAQKNKPGVYTKVYNYVKWIKNTIAANS

SEQ ID NO: 10884 - protein, 247 aa, Homo Sapiens
MNPLLILTFVAAALAAPFDDDDKIVGGYNCEENSVPYQVSLNSGYHFCGGSLINEQWVVSAGHCYKSRIQVRLGEHNIEVLEGNEQFINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGGKDSCQGDSGGPVVCNGQLQGVVSWGDGCAQKNKPGVYTKVYNYVKWIKNTIAANS

SEQ ID NO: 10885 - protein, 237 aa, Homo Sapiens
MNPLLILTFVAAALAAPFDDDDKIVGGYNCEENSVPYQVSLNSGYHFCGGSLINEQWVVSAGHCYKSRIQVRLGEHNINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGGKDSCQGDSGGPVVCNGQLQGVVSWGDGCAQKNKPGVYTKVYNYVKWIKNTIAANS

SEQ ID NO: 10886 - protein, 142 aa, Homo Sapiens
SLINEQWVVSAGHCYKSRIQVRLGEHNIEVLEGNEQFINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGG

SEQ ID NO: 10887 - protein, 875 aa, Homo Sapiens
MTLARFVLALMLGALPEVVGFDSVLNDSLHHSHRHSPPAGPHYPYYLPTQQRPPRTRPPPPLPRFPRPPRALPAQRPHALQAGHTPRPHPWGCPAGEPWVSVTDFGAPCLRWAEVPPFLERSPPASWAQLRGQRHNFCRSPDGAGRPWCFYGDARGKVDWGYCDCRHGSVRLRGGKNEFEGTVEVYASGVWGTVCSSHWDDSDASVICHQLQLGGKGIAKQTPFSGLGLIPIYWSNVRCRGDEENILLCEKDIWQGGVCPQKMAAAVTCSFSHGPTFPIIRLAGGSSVHEGRVELYHAGQWGTVCDDQWDDADAEVICRQLGLSGIAKAWHQAYFGEGSGPVMLDEVRCTGNELSIEQCPKSSWGEHNCGHKEDAGVSCTPLTDGVIRLAGGKGSHEGRLEVYYRGQWGTVCDDGWTELNTYVVCRQLGFKYGKQASANHFEESTGPIWLDDVSCSGKETRFLQCSRRQWGRHDCSHREDVSIACYPGGEGHRLSLGFPVRLMDGENKKEGRVEVFINGQWGTICDDGWTDKDAAVICRQLGYKGPARARTMAYFGEGKGPIHVDNVKCTGNERSLADCIKQDIGRHNCRHSEDAGVICDYFGKKASGNSNKESLSSVCGLRLLHRRQKRIIGGKNSLRGGWPWQVSLRLKSSHGDGRLLCGATLLSSCWVLTAAHCFKRYGNSTRSYAVRVGDYHTLVPEEFEEEIGVQQIVIHREYRPDRSDYDIALVRLQGPEEQCARFSSHVLPACLPLWRERPQKTASNCYITGWGDTGRAYSRTLQQAAIPLLPKRFCEERYKGRFTGRMLCAGNLHEHKRVDSCQGDSGGPLMCERPGESWVVYGVTSWGYGCGVKDSPGVYTKVSAFVPWIKSVTKL

SEQ ID NO: 10888 - protein, 92 aa, Homo Sapiens
MAVWLAQWLGPLLLVSLWGLLAPASLLRRLGEHIQQFQESSAQGLGLSLGPGAAALPKVGWLEQLLDPFNVSDRRSFLQAIPQPWPQPGAPW

SEQ ID NO: 10889 - protein, 257 aa, Homo Sapiens
MAVWLAQWLGPLLLVSLWGLLAPASLLRRLGEHIQQFQESSAQGLGLSLGPGAAALPKVGWLEQLLDPFNVSDRRSFLQIVLHSLGQKCLSFSRAETVAQLRSTEPQLSGVGDRQWLYQTCTEFGFYVTCENPRCPFSQLPALPSQLDLCEQVFGLSALSVAQAVAQTNSYYGGQTPGANKVLFVNGDTDPWHVLSVTQALGSSESTLLIRTGSHCLDMAPERPSDSPSLRLGRQNIFQQLQTWLKLAKESQIKGEV

SEQ ID NO: 10890 - protein, 99 aa, Homo Sapiens
MAVWLAQWLGPLLLVSLWGLLAPASLLRRLGEHIQQFQESSAQGLGLSLGPGAAALPKVGWLEQLLDPFNVSDRRSFLQMSPVRIPDVLSPSSQHCPPS

SEQ ID NO: 10891 - protein, 145 aa, Homo Sapiens
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRDCLAQPGPEVFKLFPSRDSGTAEEHRTSTVWCG

SEQ ID NO: 10892 - protein, 514 aa, Homo Sapiens
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRGHPAALAPAWGALVISLEHRFYGLSIPAGGLEMAQLRFLSSRLALADVVSARLALSRLFNISSSSPWICFGGSYAGSLAAWARLKFPHLIFASVASSAPVRAVLDFSEYNDVVSRSLMSTAIGGSLECRAAVSVAFAEVERRLRSGGAAQAALRTELSACGPLGRAENQAELLGALQALVGGVVQYDGQTGAPLSVRQLCGLLLGGGGNRSHSTPYCGLRRAVQIVLHSLGQKCLSFSRAETVAQLRSTEPQLSGVGDRQWLYQTCTEFGFYVTCENPRCPFSQLPALPSQLDLCEQVFGLSALSVAQAVAQTNSYYGGQTPGANKVLFVNGDTDPWHVLSVTQALGSSESTLLIRTGSHCLDMAPERPSDSPSLRLGRQNIFQQLQTWLKLAKESQIKGEV

SEQ ID NO: 10893 - protein, 166 aa, Homo Sapiens
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRGHPAALAPAWGALVISLEHRFYGLSIPAGGLEMAQLRFLSSRLALSCTAWARSV

SEQ ID NO: 10894 - protein, 165 aa, Homo Sapiens
  misc_feature (1)..(1): Xaa can be any naturally occurring amino acid
XVMRGHPAALAPAWGALVISLEHRFYGLSIPAGGLEMAQLRFLSSRLALADVVSARLALSRLFNISSSSPWICFGGSYAGSLAAWARLKFPHLIFASVASSAPVRAVLDFSEYNDIVLHSLGQKCLSFSRAETVAQLRSTEPQLSGVGDRQWLYQTCTEFGFYVT

SEQ ID NO: 10895 - protein, 139 aa, Homo Sapiens
  misc_feature (1)..(1): Xaa can be any naturally occurring amino acid
XVMRGHPAALAPAWGALVISLEHRFYGLSIPAGGLEMAQLRFLSSRLALADVVSARLALSRLFNISSSSPWICFGGSYAGSLAAWARLKIVLHSLGQKCLSFSRAETVAQLRSTEPQLSGVGDRQWLYQTCTEFGFYVT

SEQ ID NO: 10896 - protein, 246 aa, Homo Sapiens
MNLLLILTFVAAAVAAPFDDDDKIVGGYICEENSVPYQVSLNSGYHFCGGSLISEQWVVSAGHCYKSAINSKLSGRGCEYHRIQVRLGEHNIEVLEGNEQFINAAKIIRHPKYNSRTLDNDILLIKLSSPAVINSRESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 10897 - protein, 261 aa, Homo Sapiens
MNLLLILTFVAAAVAAPFDDDDKIVGGYICEENSVPYQVSLNSGYHFCGGSLISEQWVVSAGHCYKSAINSKLSGRGCEYHRIQVRLGEHNIEVLEGNEQFINAAKIIRHPKYNSRTLDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 10898 - protein, 247 aa, Homo Sapiens
MNLLLILTFVAAAVAAPFDDDDKIVGGYICEENSVPYQVSLNSGYHFCGGSLISEQWVVSAGHCYKSRIQVRLGEHNIEVLEGNEQFINAAKIIRHPKYNSRTLDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 10899 - protein, 247 aa, Homo Sapiens
MNPLLILAFVGAAVAAPFDDDDKIVGGYICEENSVPYQVSLNSGYHFCGGSLISEQWVVSAGHCYKSRIQVRLGEHNIEVLEGNEQFINAAKIIRHPKYNSRTLDNDILLIKLSSPAVINSRVSAISLPTAPPAAGTESLISGWGNTLSSGADYPDELQCLDAPVLSQAECEASYPGKITNNMFCVGFLEGGKDSCQGDSGGPVVSNGELQGIVSWGYGCAQKNRPGVYTKVYNYVDWIKDTIAANS

SEQ ID NO: 10900 - protein, 81 aa, Homo Sapiens
ARGAAAGAAAGSGWTQEAGVAGGGAVIRTMRPTGHHVAHRGWRGRRTRALAVAGEPAPVGFPRMRSEPAQPPLGTHGGALL

SEQ ID NO: 10901 - protein, 300 aa, Homo Sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMGDSGGPLACNKNGLWYQIGVVSWGVGCGRPNRPGVYTNISHHFEWIQKLMAQSGMSQPDPSWPLLFFPLLWALPLLGPV

SEQ ID NO: 10902 - protein, 314 aa, Homo Sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 10903 - protein, 218 aa, Homo Sapiens
  misc_feature (1)..(1): Xaa can be any naturally occurring amino acid
XLALLLARAGLRKPESQEAAPLSGPCGRRVITSRIVGGEDAELGRWPWQGSLRLWDSHVCGVSLLSHRWALTAAHCFETDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEGSSGRHHKQLYVQPPLPQVQFPQGHLWRHGLCWQCPRREGCLLR

SEQ ID NO: 10904 - protein, 81 aa, Homo Sapiens
  misc_feature (1)..(1): Xaa can be any naturally occurring amino acid
XRGAAAGAAAGSGWTQEAGVAGGGAVIRTMRPTGHHVAHRGWRGRRTRALAVAGEPAPVGFPRMRSEPAQPPLGTHGGALL

SEQ ID NO: 10905 - protein, 256 aa, Homo Sapiens
  misc_feature (1)..(1): Xaa can be any naturally occurring amino acid
XSLRLWDSHVCGVSLLSHRWALTAAHCFETDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 10906 - protein, 317 aa, Homo Sapiens
MVVSGAPPALGGGCLGTFTSLLLLASTAILNAARIPVPPACGKPQQLNRVVGGEDSTDSEWPWIVSIQKNGTHHCAGSLLTSRWVITAAHCFKDNLNKPYLFSVLLGAWQLGNPGSRSQKVGVAWVEPHPVYSWKEGACADIALVRLERSIQFSERVLPICLPDASIHLPPNTHCWISGWGSIQDGVPLPHPQTLQKLKVPIIDSEVCSHLYWRGAGQGPITEDMLCAGYLEGERDACLGDSGGPLMCQVDGAWLLAGIISWGEGCAERNRPGVYISLSAHRSWVEKIVQGVQLRGRAQGGGALRAPSQGSGAAARS

SEQ ID NO: 10907 - protein, 207 aa, Homo Sapiens
MVVSGAPPALGGGCLGTFTSLLLLASTAILNAARIPVPPACGKPQQLNRVVGGEDSTDSEWPWIVSIQKNGTHHCAVPLPHPQTLQKLKVPIIDSEVCSHLYWRGAGQGPITEDMLCAGYLEGERDACLGDSGGPLMCQVDGAWLLAGIISWGEGCAERNRPGVYISLSAHRSWVEKIVQGVQLRGRAQGGGALRAPSQGSGAAARS

SEQ ID NO: 10908 - protein, 116 aa, Homo Sapiens
  misc_feature (1)..(1): Xaa can be any naturally occurring amino acid
XLLSASALFISCSLTALCLGFFYGCEDETENAASTQRASVSSYRRRRHRLLPLASVFSHLLVLRCLPLGKHRFVLFLPQEVRGGHTSGSSVQSRGAQPSSMRPGYLFPQPVGSPSS

SEQ ID NO: 10909 - protein, 154 aa, Homo Sapiens
MAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSV

SEQ ID NO: 10910 - protein, 383 aa, Homo Sapiens
MAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSVKLSTGCTGTLVAEKHVLTAAHCIHDGKTYVKGTQKLRVGFLKPKFKDGGRGANDSTSAMPEQMKFQWIRVKRTHVPKGWIKGNANDIGMDYDYALLELKKPHKRKFMKIGVSPPAKQLPGGRIHFSGYDNDRPGNLVYRFCDVKDETYDLLYQQCDAQPGASGSGVYVRMWKRQQQKWERKIIGIFSGHQWVDMNGSPQDFNVAVRITPLKYAQICYWIKGNYLDCREG

SEQ ID NO: 10911 - protein, 82 aa, Homo Sapiens
MSRMRPVCQPWPSPHAPTTVKREGSTVSNSIQPPPPEYQLGSRTWLEAETPGQKRQCSAFMEFTEESRRASHFSSILKIEPV

SEQ ID NO: 10912 - protein, 91 aa, Homo Sapiens
MSRMRPVCQPWPSPHAPTTVKREGSTVSNSIQPPPPEYQLGSRTWLEAETPGQKRQCSAFMEFTEESRRIHQSVGTLLPRVKSFGRPNPHA

SEQ ID NO: 10913 - protein, 290 aa, Homo Sapiens
MRRPAAVPLLLLLCFGSQRAKAATACGRPRMLNRMVGGQDTQEGEWPWQVSIQRNGSHFCGGSLIAEQWVLTAAHCFRNTSETSLYQVLLGARQLVQPGPHAMYARVRQVESNPLYQGTASSADVALVELEAPVPFTNYILPVCLPDPSVIFETGMNCWVTGWGSPSEEDLLPEPRILQKLAVPIIDTPKCNLLYSKDTEFGYQPKTIKNDMLCAGFEEGKKDACKGDSGGPLVCLVGQSWLQAGVISWGEGCARQNRPGVYIRVTAHHNWIHRIIPKLQFQPARLGGQK

SEQ ID NO: 10914 - protein, 40 aa, Homo Sapiens
MRRPAAVPLLLLLCFGSQRAKAATAPLRRPCTRSCWGQGS

SEQ ID NO: 10915 - protein, 40 aa, Homo Sapiens; identical to SEQ ID NO: 10914

SEQ ID NO: 10916 - protein, 304 aa, Homo Sapiens
MCGPDDRCPARWPGPGRAVKCGKGLAAARPGRVERGGAQRGGAGLELHPLLGGRTWRAARDADGCEALGTVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 10917 - protein, 240 aa, Homo Sapiens
MGPAGEVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 10918 - protein, 261 aa, Homo Sapiens
MHMRETSGFTLKKGRSAPLVFHPPDALIAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 10919 - protein, 247 aa, Homo Sapiens
MNPFLILAFVGAAVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 10920 - protein, 178 aa, Homo Sapiens
MRETSGFTLKKGRSAPLVFHPPDALIAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPVL

SEQ ID NO: 10921 - protein, 236 aa, Homo Sapiens
MRGVSCLQVLLLLVLACGQPRMSSRIVGGRDGRDGEWPWQASIQHRGAHVCGGSLIAPQWVLTAAHCFPRRALPAEYRVRLGALRLGSTSPRTLSVPVRRVLLPPDYSEDGARGDLALLQLRRPVPLSARVQPVCLPVPGARPPPGTPCRVTGWGSLRPGVPLPEWRPLQGVRVPLLDSRTCDGLYHVGADVPQAERIVLPGSLCAGYPQGHKDACQVCTQPPQPPESPPCAQHPP

SEQ ID NO: 10922 - protein, 280 aa, Homo Sapiens
MRGVSCLQVLLLLVLGAAGTQGRKSAACGQPRMSSRIVGGRDGRDGEWPWQASIQHRGAHVCGGSLIAPQWVLTAAHCFPRRALPAEYRVRLGALRLGSTSPRTLSVPVRRVLLPPDYSEDGARGDLALLQLRRPVPLSARVQPVCLPVPGARPPPGTPCRVTGWGSLRPGVPLPEWRPLQGVRVPLLDSRTCDGLYHVGADVPQAERIVLPGSLCAGYPQGHKDACQGDSGGPLTCLQSGSWVLVGVVSWGKGCALPNRPGVYTSVATYSPWIQARVSF

SEQ ID NO: 10923 - protein, 280 aa, Homo Sapiens; identical to SEQ ID NO: 10922

SEQ ID NO: 10924 - protein, 115 aa, Homo Sapiens
MRGVSCLQVLLLLVLGAAGTQGRKSAACGQPRMSSRIVGGRDGRDGEWPWQASIQHRGAHVCGGSLIAPQWVLTAAHCFPSAPPRVATATRSKGAAAGLAHLRRPLPRGRGRAPG

SEQ ID NO: 10925 - protein, 413 aa, Homo Sapiens
MENMLLWLIFFTPGWTLIDGSEMEWDFMWHLRKVPRIVSERTFHLTSPAFEADAKMMVNTVCGIECQKELPTPSLSELEDYLSYETVFENGTRTLTRVKVQDLVLEPTQNITTKGVSVRRKRQVYGTDSRFSILDKRFLTNFPFSTAVKLSTGCSGILISPQHVLTAAHCVHDGKDYVKGSKKLRVGLLKMRNKSGGKKRRGSKRSRREASGGDQREGTREHLRERAKGGRRRKKSGRGQRIAEGRPSFQWTRVKNTHIPKGWARGGMGDATLDYDYALLELKRAHKKKYMELGISPTIKKMPGGMIHFSGFDNDRADQLVYRFCSVSDESNDLLYQYCDAESGSTGSGVYLRLKDPDKKNWKRKIIAVYSGHQWVDVHGVQKDYNVAVRITPLKYAQICLWIHGNDANCAYG

SEQ ID NO: 10926 - protein, 855 aa, Homo Sapiens
MARHLLLPLVMLVISPIPGAFQDSALSPTQEEPEDLDCGRPEPSARIVGGSNAQPGTWPWQVSLHHGGGHICGGSLIAPSWVLSAAHCFMTNGTLEPAAEWSVLLGVHSQDGPLDGAHTRAVAAIVVPANYSQVELGADLALLRLASPASLGPAVWPVCLPRASHRFVHGTACWATGWGDVQEADPLPLPWVLQEVELRLLGEATCQCLYSQPGPFNLTLQILPGMLCAGYPEGRRDTCQGDSGGPLVCEEGGRWFQAGITSFGFGCGRRNRPGVFTAVATYEAWIREQVMGSEPGPAFPTQPQKTQSDPQEPREENCTIALPECGKAPRPGAWPWEAQVMVPGSRPCHGALVSESWVLAPASCFLDPNSSDSPPRDLDAWRVLLPSRPRAERVARLVQHENASWDNASDLALLQLRTPVNLSAASRPVCLPHPEHYFLPGSRCRLARWGRGEPALGPGALLEAELLGGWWCHCLYGRQGAAVPLPGDPPHALCPAYQEKEEVGSCWNDSRWSLLCQEEGTWFLAGIRDFPSGCLRPRAFFPLQTHGPWISHVTRGAYLEDQLAWDWGPDGEETETQTCPPHTEHGACGLRLEAAPVGVLWPWLAEVHVAGDRVCTGILLAPGWVLAATHCVLRPGSTTVPYIEVYLGRAGASSLPQGHQVSRLVISIRLPQHLGLRPPLALLELSSRVEPSPSALPICLHPAGIPPGASCWVLGWKEPQDRVPVAAAVSILTQRICDCLYQGILPPGTLCVLYAEGQENRCEMTSAPPLLCQMTEGSWILVGMAVQGSRELFAAIGPEEAWISQTVGEANFLPPSGSPHWPTGGSNLCPPELAKASGSPHAVYFLLLLTLLIQS

SEQ ID NO: 10927 - protein, 752 aa, Homo Sapiens
MARHLLLPLVMLVISPIPGAFQDSALSPTQEEPEDLDCGRPEPSARIVGGSNAQPGTWPWQVSLHHGGGHICGGSLIAPSWVLSAAHCFMTNGTLEPAAEWSVLLGVHSQDGPLDGAHTRAVAAIVVPANYSQVELGADLALLRLASPASLGPAVWPVCLPRASHRFVHGTACWATGWGDVQEADPLPLPWVLQEVELRLLGEATCQCLYSQPGPFNLTLQILPGMLCAGYPEGRRDTCQGDSGGPLVCEEGGRWFQAGITSFGFGCGRRNRPGVFTAVATYEAWIREQVMGSEPGPAFPTQPQKTQSDPQEPREENCTIALPECGKAPRPGAWPWEAQVMVPGSRPCHGALVSESWVLAPASCFLDPNSSDSPPRDLDAWRVLLPSRPRAERVARLVQHENASWDNASDLALLQLRTPVNLSAASRPVCLPHPEHYFLPGSRCRLARWGRGEPALGPGALLEAELLGGWWCHCLYGRQGAAVPLPGDPPHALCPAYQEKEEVGSCWNDSRWSLLCQEEGTWFLAGIRDFPSGCLRPRAFFPLQTHGPWISHVTRGAYLEDQLAWDWGPDGEETETQTCPPHTEHGACGLRLEAAPVGVLWPWLAEVHVAGDRVCTGILLAPGWVLAATHCVLRPGSTTVPYIEVYLGRAGASSLPQGHQMTSAPPLLCQMTEGSWILVGMAVQGSRELFAAIGPEEAWISQTVGEANFLPPSGSPHWPTGGSNLCPPELAKASGSPHAVYFLLLLTLLIQS

SEQ ID NO: 10928 - protein, 850 aa, Homo Sapiens
MARHLLLPLVMLVISPIPGAFQDSALSPTQEEPEDLDCGRPEPSARIVGGSNAQPGTWPWQVSLHHGGGHICGGSLIAPSWVLSAAHCFMTNGTLEPAAEWSVLLGVHSQDGPLDGAHTRAVAAIVVPANYSQVELGADLALLRLASPASLGPAVWPVCLPRASHRFVHGTACWATGWGDVQEADPLPLPWVLQEVELRLLGEATCQCLYSQPGPFNLTLQILPGMLCAGYPEGRRDTCQGDSGGPLVCEEGGRWFQAGITSFGFGCGRRNRPGVFTAVATYEAWIREQVMGSEPGPAFPTQPQKTQSDPQEPREENCTIALPECGKAPRPGAWPWEAQVMVPGSRPCHGALVSESWVLAPASCFLDPNSSDSPPRDLDAWRVLLPSRPRAERVARLVQHENASWDNASDLALLQLRTPVNLSAASRPVCLPHPEHYFLPGSRCRLARWGRGEPALGPGALLEAELLGGWWCHCLYGRQGAAVPLPGDPPHALCPAYQEKEENDSRWSLLCQEEGTWFLAGIRDFPSGCLRPRAFFPLQTHGPWISHVTRGAYLEDQLAWDWGPDGEETETQTCPPHTEHGACGLRLEAAPVGVLWPWLAEVHVAGDRVCTGILLAPGWVLAATHCVLRPGSTTVPYIEVYLGRAGASSLPQGHQVSRLVISIRLPQHLGLRPPLALLELSSRVEPSPSALPICLHPAGIPPGASCWVLGWKEPQDRVPVAAAVSILTQRICDCLYQGILPPGTLCVLYAEGQENRCEMTSAPPLLCQMTEGSWILVGMAVQGSRELFAAIGPEEAWISQTVGEANFLPPSGSPHWPTGGSNLCPPELAKASGSPHAVYFLLLLTLLIQS

SEQ ID NO: 10929 - protein, 28 aa, Homo Sapiens
  misc_feature (1)..(1): Xaa can be any naturally occurring amino acid
XIEVYLGRAGASSLPQGHQSLWLLLSPS

SEQ ID NO: 10930 - protein, 65 aa, Homo Sapiens
MKYVFYLGVLAERRPCSLFGVPQVSLQPLCGRPHQTQLGAGPSSLLFTKSESDAGKFQEQSQRRY

SEQ ID NO: 10931 - protein, 68 aa, Homo Sapiens
MKYVFYLGVLAGTFFFADSSVQKEDPAPYLVYLKSHFNPCVGVLIKPSWVLAPAHCYLPMNAFYHLKI

SEQ ID NO: 10932 - protein, 235 aa, Homo Sapiens
MKYVFYLGVLAGTFFFADSSVQKEDPAPYLVYLKSHFNPCVGVLIKPSWVLAPAHCYLPNLKVMLGNFKSRVRDGTEQTINPIQIVRYWNYSHSAPQDDLMLIKLAKPAMLNPKVQPLTLATTNVRPGTVCLLSGLDWSQENSGRHPDLRQNLEAPVMSDRECQKTEQGKSHRNSLCVKFVKVFSRIFGEVAVATVICKDKLQGIEVGHFMGGDVGIYTNVYKYVSWIENTAKDK

SEQ ID NO: 10933 - protein, 235 aa, Homo Sapiens; identical to SEQ ID NO: 10932

SEQ ID NO: 10934 - protein, 326 aa, Homo Sapiens
MAAPASVMGPLGPSALGLLLLLLVVAPPRVAALVHRQPENQGISLTGSVACGRPSMEGKILGGVPAPERKWPWQVSVHYAGLHVCGGSILNEYWVLSAAHCFHRDKNIKIYDMYVGLVNLRVAGNHTQWYEVNRVILHPTYEMYHPIGGDVALVQLKTRIVFSESVLPVCLATPEVNLTSANCWATGWGLVSKQGETSDELQEMQLPLILEPWCHLLYGHMSYIMPDMLCAGDILNAKTVCEGDSGGPLVCEFNRSWLQIGIVSWGRGCSNPLYPGVYASVSYFSKWICDNIEITPTPAQPAPALSPALGPTLSVLMAMLAGWSVL

SEQ ID NO: 10935 - protein, 100 aa, Homo Sapiens
MASFLAVVGAPGGVNSCVFDRFHYSVKMGDRSVYNENTSVVVSVQRAFVHPKFSTVTTIRNDLALLQLQHPVNFTSNIQPICIPQENFQVEGRFWGPLGL

SEQ ID NO: 10936 - protein, 293 aa, Homo Sapiens
MSSGGGSRGLLAWLLLLQPWPGQNWAGMAAPRLPSPLLSEEGGENPEASPAPGPEAGPPLNLFTSFPGDSLLCGRTPLRIVGGVDAEEGRWPWQVSVRTKGRHICGGTLVTATWVLTAGHCISSRFHYSVKMGDRSVYNENTSVVVSVQRAFVHPKFSTVTTIRNDLALLQLQHPVNFTSNIQPICIPQENFQVEGRTRCWVTGWGKTPEREKLASEILQDVDQYIMCYEECNKIIQKALSSTKDVIIKGMVCGYKEQGKDSCQGDSGGRLACEYNDTWVQVGIVSWGIGCGR

SEQ ID NO: 10937 - protein, 185 aa, Homo Sapiens
MGPAGCAFTLLLLLGISDRDYHSALQEAEVPIIDRQACEQLYNPIGIFLPALEPVIKEDKICAGDTQNMKDSCKGDSGGPLSCHIDGVWIQTGVVSWGLECGKSLPGVYTNVIYYQKWINATISRANNLDFSDFLFPIVLLSLALLRPSCAFGPNTIHRVGTVAEAVACIQGWEENAWRFSPRGR

SEQ ID NO: 10938 - protein, 328 aa, Homo Sapiens
MGPAGCAFTLLLLLGISVCGQPVYSSRVVGGQDAAAGRWPWQVSLHFDHNFICGGSLVSERLILTAAHCIQPTWTTFSYTVWLGSITVGDSRKRVKYYVSKIVIHPKYQDTTADVALLKLSSQVTFTSAILPICLPSVTKQLAIPPFCWVTGWGKVKESSDRDYHSALQEAEVPIIDRQACEQLYNPIGIFLPALEPVIKEDKICAGDTQNMKDSCKGDSGGPLSCHIDGVWIQTGVVSWGLECGKSLPGVYTNVIYYQKWINATISRANNLDFSDFLFPIVLLSLALLRPSCAFGPNTIHRVGTVAEAVACIQGWEENAWRFSPRGR

SEQ ID NO: 10939 - protein, 385 aa, Homo Sapiens
MGRWCQTVARGQRPRTSAPSRAGALLLLLLLLRSAGCWGAGEAPGALSTADPADQSVQCVPKATCPSSRPRLLWQTPTTQTLPSTTMETQFPVSEGKVDPYRSCGFSYEQDPTLRDPEAVARRWPWMVSVRANGTHICAGTIIASQWVLTVAHCLIWRDVIYSVRVGSPWIDQMTQTASDVPVLQVIMHSRYRAQRFWSWVGQANDIGLLKLKQELKYSNYVRPICLPGTDYVLKDHSRCTVTGWGLSKADGMWPQFRTIQEKEVIILNNKECDNFYHNFTKIPTLVQIIKSQMMCAEDTHREKFCYELTGEPLVCSMEGTWYLVGLVSWGAGCQKSEAPPIYLQVSSYQHWIWDCLNGQALALPAPSRTLLLALPLPLSLLAAL

SEQ ID NO: 10940 - protein, 553 aa, Homo Sapiens
MKWCWGPVLLIAGATVLMEGLQAAQRACGQRGPGPPKPQEGNTVPGEWPWQASVRRQGAHICSGSLVADTWVLTAAHCFEKAAATELNSWSVVLGSLQREGLSPGAEEVGVAALQLPRAYNHYSQGSDLALLQLAHPTTHTPLCLPQPAHRFPFGASCWATGWDQDTSDAPGTLRNLRLRLISRPTCNCIYNQLHQRHLSNPARPGMLCGGPQPGVQGPCQGDSGGPVLCLEPDGHWVQAGIISFASSCAQEDAPVLLTNTAAHSSWLQARVQGAAFLAQSPETPEMSDEDSCVACGSLRTAGPQAGAPSPWPWEARLMHQGQLACGGALVSEEAVLTAAHCFIGRQAPEEWSVGLGTRPEEWGLKQLILHGAYTHPEGGYDMALLLLAQPVTLGASLRPLCLPYPDHHLPDGERGWVLGRARPGAGISSLQTVPVTLLGPRACSRLHAAPGGDGSPILPGMVCTSAVGELPSCEGLSGAPLVHEVRGTWFLAGLHSFGDACQGPARPAVFTALPAYEDWVSSLDWQVYFAEEPEPEAEPGSCLANISQPTSC

SEQ ID NO: 10941 - protein, 203 aa, Homo Sapiens
MDPSKIAHTEYPVNTIIIHEDFDNNSMSNNIALLKTDTAMHFGNLVQSICFLGRMLHTPPVLQNCWVSGWNPTSATGNHMTMSVLRKIFVKDLDMCPLYKLQKTECGSHTKEETKTACLGDPGSPMMCQLQQFDLWVLRGVLNFGGETCPGLFLYTKVEDYSKWITSKAERAGPPLSSLHHWEKLISFSHHGPNATMTQKTYS

SEQ ID NO: 10942 - protein, 296 aa, Homo Sapiens
MDPSKIAHTEYPVNTIIIHEDFDNNSMSNNIALLKTDTAMHFGNLVQSICFLGRMLHTPPVLQNCWVSGWNPTSATGNHMTMSVLRKIFVKDLDMCPLYKLQKTECGSHTKEETKTACLGDPGSPMMCQLQQFDLWVLRGVLNFGGETCPGLFLYTKVEDYSKWITSKAERAGPPLSSLHHWEKLISFSHHGPNATMTQKTYSDSELGHVGSYLQGQRRTITHSRLGNSSRDSLDVREKDVKESGRSPEASVQPLYYDYYGGEVGEGRIFAGQNRLYQPEEIILVSFVLVFFCSSI

SEQ ID NO: 10943 - protein, 186 aa, Homo Sapiens
MVSAAGLSGDGKMRGVLLVLLGLLYSSTSCGVQKASVFYGPDPKEGLVSSMEFPWVVSLQDSQYTHLAFGCILSEFWVLSIASAIQNRKDIVVIVGISNMDPSKIAHTEYPVNTIIIHEDFDNNSMSNNIALLKTDTAMHFGNLVQSICFLGRMLHTPPVLQNCWVSGWNPTSATGNHMTMSVLRK

SEQ ID NO: 10944 - protein, 395 aa, Homo Sapiens
MVSAAGLSGDGKMRGVLLVLLGLLYSSTSCGVQKASVFYGPDPKEGLVSSMEFPWVVSLQDSQYTHLAFGCILSEFWVLSIASAIQNRKDIVVIVGISNMDPSKIAHTEYPVNTIIIHEDFDNNSMSNNIALLKTDTAMHFGNLVQSICFLGRMLHTPPVLQNCWVSGWNPTSATGNHMTMSVLRKIFVKDLDMCPLYKLQKTECGSHTKEETKTACLGDPGSPMMCQLQQFDLWVLRGVLNFGGETCPGLFLYTKVEDYSKWITSKAERAGPPLSSLHHWEKLISFSHHGPNATMTQKTYSDSELGHVGSYLQGQRRTITHSRLGNSSRDSLDVREKDVKESGRSPEASVQPLYYDYYGGEVGEGRIFAGQNRLYQPEEIILVSFVLVFFCSSI

SEQ ID NO: 10945 - protein, 395 aa, Homo Sapiens; identical to SEQ ID NO: 10944

SEQ ID NO: 10946 - protein, 352 aa, Homo Sapiens
MLLFSVLLLLSLVTGTQLGPRTPLPEAGVAILGRARGAHRPQPPHPPSPVSECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAADKNSVKTDLMKAPMVIMDWEECSKMFPKLTKNMLCAGYKNESYDACKGDSGGPLVCTPEPGEKWYQVGIISWGKSCGEKNTPGIYTSLVNYNLWIEKVTQLEGRPFNAEKRRTSVKQKPMGSPVSGVPEPGSPRSWLLLCPLSHVLFRAILY

SEQ ID NO: 10947 - protein, 276 aa, Homo Sapiens
MLLFSVLLLLSLVTGTQLGPRTPLPEAGVAILGRARGAHRPQPPHPPSPVSECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAADKNSVKTDLMKAPMVIMDWEECSKMFPKLTKNMLCAGYKNESYDACKQSYFPTLQRMNTGSSQTKPPGSHTFHLQN

SEQ ID NO: 10948 - protein, 182 aa, Homo Sapiens
  misc_feature (1)..(1): Xaa can be any naturally occurring amino acid
XWKPAPPSPVPSSHWMLTKCFPFSFPLSFFPPECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAGM

SEQ ID NO: 10949 - protein, 604 aa, Homo Sapiens
MLLAVLLLLPLPSSWFAHGHPLYTRLPPSALQVLSAQGTQALQAAQRSAQWAINRVAMEIQHRSHECRGSGRPRPQALLQDPPEPGPCGERRPSTANVTRAHGRIVGGSAAPPGAWPWLVRLQLGGQPLCGGVLVAASWVLTAAHCFVGAPNELLWTVTLAEGSRGEQAEEVPVNRILPHPKFDPRTFHNDLALVQLWTPVSPGGSARPVCLPQEPQEPPAGTACAIAGWGALFEDGPEAEAVREARVPLLSTDTCRRALGPGLRPSTMLCAGYLAGGVDSCQGDSGGPLTCSEPGPRPREVLFGVTSWGDGCGEPGKPGVYTRVAVFKDWLQEQMSAASSSREPSCRELLAWDPPQELQADAARLCAFYARLCPGSQGACARLAHQQCLQRRRRCELRSLAHTLLGLLRNAQELLGPRPGLRRLAPALALPAPALRESPLHPARELRLHSGSRAAGTRFPKRRPEPRGEANGCPGLEPLRQKLAALQGAHAWILQVPSEHLAMNFHEVLADLGSKTLTGLFRAWVRAGLGGRHVAFSGLVGLEPATLARSLPRLLVQALQAFRVAALAEGEPEGPWMDVGQGPGLERKGHHPLNPQVPPARQP

SEQ ID NO: 10950 - protein, 603 aa, Homo Sapiens
MLLAVLLLLPLPSSWFAHGHPLYTRLPPSALQVLSAQGTQALQAAQRSAQWAINRVAMEIQHRSHECRGSGRPRPQALLQDPPEPGPCGERRPSTANVTRAHGRIVGGSAAPPGAWPWLVRLQLGGQPLCGGVLVAASWVLTAAHCFVGAPNELLWTVTLAEGSRGEQAEEVPVNRILPHPKFDPRTFHNDLALVQLWTPVSPGGSARPVCLPQEPQEPPAGTACAIAGWGALFEDGPEAEAVREARVPLLSTDTCRRALGPGLRPSTMLCAGYLAGGVDSCQGDSGGPLTCSEPGPRPREVLFGVTSWGDGCGEPGKPGVYTRVAVFKDWLQEQMSASSSREPSCRELLAWDPPQELQADAARLCAFYARLCPGSQGACARLAHQQCLQRRRRCELRSLAHTLLGLLRNAQELLGPRPGLRRLAPALALPAPALRESPLHPARELRLHSGSRAAGTRFPKRRPEPRGEANGCPGLEPLRQKLAALQGAHAWILQVPSEHLAMNFHEVLADLGSKTLTGLFRAWVRAGLGGRHVAFSGLVGLEPATLARSLPRLLVQALQAFRVAALAEGEPEGPWMDVGQGPGLERKGHHPLNPQVPPARQP

SEQ ID NO: 10951 - protein, 283 aa, Homo Sapiens
MGLGLRGWGRPLLTVATALMLPVKPPAGSWGAQIIGGHEVTPHSRPYMASVRFGGQHHCGGFLLRARWVVSAAHCFSHRDLRTGLVVLGAHVLSTAEPTQQVFGIDALTTHPDYHPMTHANDICLLRLNGSAVLGPAVGLLRPPGRRARPPTAGTRCRVAGWGFVSDFEELPPGLMEAKVRVLDPDVCNSSWKGHLTLTMLCTRSGDSHRRGFCSADSGGPLVCRNRAHGLVSFSGLWCGDPKTPDVYTQVSAFVAWIWDVVRRSSPQPGPLPGTTRPPGEAA

SEQ ID NO: 10952 - protein, 282 aa, Homo Sapiens
MGLGLRGWGRPLLTVATALMLPVKPPGSWGAQIIGGHEVTPHSRPYMASVRFGGQHHCGGFLLRARWVVSAAHCFSHRDLRTGLVVLGAHVLSTAEPTQQVFGIDALTTHPDYHPMTHANDICLLRLNGSAVLGPAVGLLRPPGRRARPPTAGTRCRVAGWGFVSDFEELPPGLMEAKVRVLDPDVCNSSWKGHLTLTMLCTRSGDSHRRGFCSADSGGPLVCRNRAHGLVSFSGLWCGDPKTPDVYTQVSAFVAWIWDVVRRSSPQPGPLPGTTRPPGEAA

SEQ ID NO: 10953 - protein, 241 aa, Homo Sapiens
MKFILLWALLNLTVALAFNPDYTVSSTPPYLVYLKSDYLPCAGVLIHPLWVITAAHCNLPKLRVILGVTIPADSNEKHLQVIGYEKMIHHPHFSVTSIDHDIMLIKLKTEAELNDYVKLANLPYQTISENTMCSVSTWSYNVCDIYKEPDSLQTVNISVISKPQCRDAYKTYNITENMLCVGIVPGRRQPCKEVSAAPAICNGMLQGILSFADGCVLRADVGIYAKIFYYIPWIENVIQNN

SEQ ID NO: 10954 - protein, 241 aa, Homo Sapiens; identical to SEQ ID NO: 10953

SEQ ID NO: 10955 - protein, 108 aa, Homo Sapiens [sequence omitted]

SEQ ID NO: 10956 - protein, 343 aa, Homo Sapiens
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 10957 - protein, 195 aa, Homo Sapiens
MAQKGVLGPGQLGAVAILLYLGLLRSGTGAEGAEAPCGVAPQARITGGSSAVAGQWPWQVSITYEGVHVCGGSLVSEQWVLSAAHCFPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGK

SEQ ID NO: 10958 - protein, 289 aa, Homo Sapiens
MAQKGVLGPGQLGAVAILLYLGLLRSGTGAEGAEAPCGVAPQARITGGSSAVAGQWPWQVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 10959 - protein, 218 aa, Homo Sapiens
EYQVVIGNDTTHYIIDDLEPASNYTFYIVAYMPMGASQMSDHVTQNTLEDVPLRPPEISLTSRSPTDILISWLPIPAKYRRGQVVLYRLSFRLSTENSIQVLELPGTTHEYLLEGLKPDSVYLVRITAATRVGLGESSVWTSHRTPKATSVKAPKSPELHLEPLNCTTISVRWQQDVEDTAAIQGYKLYYKEEGQQENGPIFLDTKDLLYTLSGLARI

SEQ ID NO: 10960 - protein, 137 aa, Homo Sapiens
MAPPLRPLARLRPPGMLLRALLLLLLLSPLPGVWCFSELSFVKEPQDVTVTRKDPVVLDCQAHGEVPIKVTWLKNGAKMSENKRIEVLSNGSLYISEVEGRRGEQSDEGFYQCLAMNKYGAILSQKAHLALSRIGST

SEQ ID NO: 10961 - protein, 1150 aa, Homo Sapiens
MAPPLRPLARLRPPGMLLRALLLLLLLSPLPGVWCFSELSFVKEPQDVTVTRKDPVVLDCQAHGEVPIKVTWLKNGAKMSENKRIEVLSNGSLYISEVEGRRGEQSDEGFYQCLAMNKYGAILSQKAHLALSTISAFEVQPISTEVHEGGVARFACKISSHPPAVITWEFNRTTLPMTMDRITALPTGVLQIYDVSQRDSGNYRCIAATVAHRRKSMEASLTVIPAKESKSFHTPTIIAGPQNITTSLHQTVVLECMATGNPKPIISWSRLDHKSIDVFNTRVLGNGNLMISDVRLQHAGVYVCRATTPGTRNFTVAMATLTVLAPPSFVEWPESLTRPRAGTARFVCQAEGIPSPKMSWLKNGRKIHSNGRIKMYNSKLVINQIIPEDDAIYQCMAENSQGSILSRARLTVVMSEDRPSAPYNVHAETMSSSAILLAWERPLYNSDKVIAYSVHYMKAEGLNNEEYQVVIGNDTTHYIIDDLEPASNYTFYIVAYMPMGASQMSDHVTQNTLEDVPLRPPEISLTSRSPTDILISWLPIPAKYRRGQVVLYRLSFRLSTENSIQVLELPGTTHEYLLEGLKPDSVYLVRITAATRVGLGESSVWTSHRTPKATSVKAPKSPELHLEPLNCTTISVRWQQDVEDTAAIQGYKLYYKEEGQQENGPIFLDTKDLLYTLSGLDPRRKYHVRLLAYNNIDDGYQADQTVSTPGCVSVRDRMVPPPPPPHHLYAKANTSSSIFLHWRRPAFTAAQIINYTIRCNPVGLQNASLVLYLQTSETHMLVQGLEPNTKYEFAVRLHVDQLSSPWSPVVYHSTLPEAPAGPPVGVKVTLIEDDTALVSWKPPDGPETVVTRYTILYASRKAWIAGEWQVLHREGAITMALLENLVAGNVYIVKISASNEVGEGPFSNSVELAVLPKETSESNQRPKRLDSADAKVYSGYYHLDQKSMTGIAVGVGIALTCILICVLILIYRSKARKSSASKTAQNGTQQLPRTSASLASGNEVGKNLEGAVGNEESLMPMIMPNSFIDAKGGTDLIINSYGPIIKNNSKKKWFFFQDSKKIQVEQPQRRFTPAVCFYQPGTTVLISDEDSPSSPGQTTSFSRPFGVAADTEHSANSEGSHETGDSGRFSHESNDEIHLSSVISTTPPNL

SEQ ID NO: 10962 - protein, 22 aa, Homo Sapiens
MSENKRIEVLSNGSLYISEVEG

SEQ ID NO: 10963 - protein, 256 aa, Homo Sapiens
MAHRPPSPALASVLLALLLSGAARAAEIVGGHEAQPHSRPYMASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 10964 - protein, 215 aa, Homo Sapiens
MASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 10965 - protein, 527 aa, Homo Sapiens [sequence omitted]

SEQ ID NO: 10966 - protein, 524 aa, Homo Sapiens
MYALFLLASLLGAALAGPVLGLKECTRGSAVWCQNVKTASDCGAVKHCLQTVWNKPTVKSLPCDICKDVVTAAGDMLKDNATEEEILVYLEKTCDWLPKPNMSASCKEIVDSYLPVILDIIKGEMSRPGEVCSALNLCESLQKHLAELNHQKQLESNKIPELDMTEVVAPFMANIPLLLYPQDGPRSKPQPKDNGDVCQDCIQMVTDIQTAVRTNSTFVQALVEHVKEECDRLGPGMADICKNYISQYSEIAIQMMMHMQPKEICALVGFCDEVKEMPMQTLVPAKVASKNVIPALELVEPIKKHEVPAKSDVYCEVCEFLVKEVTKLIDNNKTEKEILDAFDKMCSKLPKSLSEECQEVVDTYGSSILSILLEEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWN

SEQ ID NO: 10967 - protein, 240 aa, Homo Sapiens
MYALFLLASLLGAALAGPVLGLKECTRGSAVWCQNVKTASDCGAVKHCLQTVWNKPTVKSLPCDICKDVVTAAGDMLKDNATEEEILVYLEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWN

SEQ ID NO: 10968 - protein, 167 aa, Homo Sapiens
  misc_feature (1)..(1): Xaa can be any naturally occurring amino acid
XCIQMVTDIQTAVRTNSTFVQALVEHVKEECDRLGPGMADICKNYISQYSEIAIQMMMHMQDQQPKEICALVGFCDEVKEMPMQTLVPAKVASKNVIPALELVEPIKKHEVPAKSDVYCEVCEFLVKEVTKLIDNNKTEKEILDAFDKMCSKLPKSLSEECQEVVDT

SEQ ID NO: 10969 - protein, 521 aa, Homo Sapiens
MLCALLLLPSLLGATRASPTSGPQECAKGSTVWCQDLQTAARCGAVGYCQGAVWNKPTAKSLPCDVCQDIAAAAGNGLNPDATESDILALVMKTCEWLPSQESSAGCKWMVDAHSSAILSMLRGAPDSAPAQVCTALSLCEPLQRHLATLRPLSKEDTFEAVAPFMANGPLTFHPRQAPEGALCQDCVRQVSRLQEAVRSNLTLADLNIQEQCESLGPGLAVLCKNYLFQFFVPADQALRLLPPQELCRKGGFCEELGAPARLTQVVAMDGVPSLELGLPRKQSEMQMKAGVTCEVCMNVVQKLDHWLMSNSSELMITHALERVCSVMPASITKECIILVDTYSPSLVQLVAKITPEKVCKFIRLCGNRRRARAVHDAYAIVPSPEWDAENQGSFCNGCKRLLTVSSHNLESKSTKRDILVAFKGGCSILPLPYMIQCKHFVTQYEPVLIESLKDMMDPVAVCKKVGACHGPRTPLLGTDQCALGPSFWCRSQEAAKLCNAVQHCQKHVWKEMHLHAGEHA

SEQ ID NO: 10970 - protein, 426 aa, Homo Sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSGKWIPASLAIGF

SEQ ID NO: 10971 - protein, 428 aa, Homo Sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSAYSSSINYTSGNRN

SEQ ID NO: 10972 - protein, 419 aa, Homo Sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSDWTVP

SEQ ID NO: 10973 - protein, 417 aa, Homo Sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSEAL

SEQ ID NO: 10974 - protein, 326 aa, Homo Sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSDWTVP

SEQ ID NO: 10975 - protein, 324 aa, Homo Sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSEAL

SEQ ID NO: 10976 - protein, 154 aa, Homo Sapiens
MRDLYHYITSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSA

SEQ ID NO: 10977 - protein, 242 aa, Homo Sapiens
  misc_feature (1)..(1): Xaa can be any naturally occurring amino acid
XSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSASRSDPVTLNLLHGPDLPRIYPSFTYYRSGEVLYLSCSADSNPPAQYSWTINEKFQLPGQKLFIRHITTKHSGLYVCSVRNSATGKESSKSMTVEVS

SEQ ID NO: 10978 - protein, 335 aa, Homo Sapiens
MGPLSAPPCTEHIKWKGLLLTALLLNFWNLPTTAQVMIEAQPPKVSEGKDVLLLVHNLPQNLTGYIWYKGQIRDLYHYITSYVVDGQIIIYGPAYSGRETVYSNASLLIQNVTREDAGSYTLHIIKRGDGTRGVTGYFTFTLYLETPKPSISSSNLNPREAMETVILTCNPETPDASYLWWMNGQSLPMTHRMQLSETNRTLFLFGVTKYTAGPYECEIWNSGSASRSDPVTLNLLHGPDLPRIFPSVTSYYSGENLDLSCFANSNPPAQYSWTINGKFQLSGQKLFIPQITPKHNGLYACSARNSATGEESSTSLTIRVIAPPGLGTFAFNNPT

SEQ ID NO: 10979 - protein, 320 aa, Homo Sapiens
MGPLSAPPCTEHIKWKGLLLTALLLNFWNLPTTAQVMIEAQPPKVSEGKDVLLLVHNLPQNLTGYIWYKGQIRDLYHYITSYVVDGQIIIYGPAYSGRETVYSNASLLIQNVTREDAGSYTLHIIKRGDGTRGVTGYFTFTLYPKLPMPYITINNLNPRENKDVLTFTCEPKSENYAYIWWLNCQSLPVSPRVKRPIENRILILPSVTRNETGPYQCEIRDRYGGIRSDSVTLNVLYGPDLPRIFPSVTSYYSGENLDLSCFANSNPPAQYSWTINGKFQLSGQKLFIPQITPKHNGLYACSARNSATGEESSTSLTIRV

SEQ ID NO: 10980 - protein, 213 aa, Homo Sapiens
MGPLSAPPCTEHIKWKGLLLTVETPKPSISSSNLNPREAMETVILTCNPETPDASYLWWMNGQSLPMTHRMQLSETNRTLFLFGVTKYTAGPYECEIWNSGSASRSDPVTLNLLHGPDLPRIFPSVTSYYSGENLDLSCFANSNPPAQYSWTINGKFQLSGQKLFIPQITPKHNGLYACSARNSATGEESSTSLTIRVIAPPGLGTFAFNNPT

SEQ ID NO: 10981 - protein, 213 aa, Homo Sapiens; identical to SEQ ID NO: 10980

SEQ ID NO: 10982 - protein, 126 aa, Homo Sapiens
MIEAQPPKVSEGKDVLLLVHNLPQNLTGYIWYKGQIRDLYHYITSYVVDGQIIIYGPAYSGRETVYSNASLLIQNVTREDAGSYTLHIIKRGDGTRGVTGYFTFTLYRHSLDSALSLEVTGSSQSL

SEQ ID NO: 10983 - protein, 335 aa, Homo Sapiens
MGPLSAPPCTEHIKWKGLLVTASLLNFWNLPTTAQVTIEAQPPKVSEGKDVLLLVHNLPQNLTGYIWYKGQIRDLYHYITSYVVDGQIIIYGPAYSGRETAYSNASLLIQNVTREDAGSYTLHIIKRGDGTRGVTGYFTFTLYLETPKPSISSSNLNPREAMETVILTCDPETPDTSYQWWMNGQSLPMTHRFQLSETNRTLFLFGVTKYTAGPYECEIRNSGSASRSDPVTLNLLHGPDLPRIHPSYTNYRSGDNLYLSCFANSNPPAQYSWTINGKFQQSGQNLFIPQITTKHSGLYVCSVRNSATGEESSTSLTVKVSASTRIGLLPLLNPT

SEQ ID NO: 10984 - protein, 117 aa, Homo Sapiens
  misc_feature (1)..(1): Xaa can be any naturally occurring amino acid
XRNSGSASRSDPVTLNLLHGPDLPRIHPSYTNYRSGDNLYLSCFANSNPPAQYSWTINGKFQQSGQNLFIPQITTKHSGLYVCSVRNSATGEESSTSLTVKVSASTRIGLLPLLNPT

SEQ ID NO: 10985 - protein, 428 aa, Homo Sapiens
MGPLSAPPCTQRITWKGLLLTALLLNFWNLPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLETPKPSISSSNLYPREDMEAVSLTCDPETPDASYLWWMNGQSLPMTHSLQLSKNKRTLFLFGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLYGPDLPRIYPSFTYYHSGENLYLSCFADSNPPAEYSWTINGKFQLSGQKLFIPQITTKHSGLYACSVRNSATGMESSKSMTVKVSAPSGTGHLPGLNPL

SEQ ID NO: 10986 - protein, 475 aa, Homo Sapiens
MGPLSAPPCTQRITWKGLLLTALLLNFWNLPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLETPKPSISSSNLYPREDMEAVSLTCDPETPDASYLWWMNGQSLPMTHSLQLSKNKRTLFLFGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLYGPDLPRIYPSFTYYHSGENLYLSCFADSNPPAEYSWTINGKFQLSGQKLFIPQITTKHSGLYACSVRNSATGMESSKSMTVKVSDSCFHSSSKYLPSATVQNCFLFKEIYEKTLTRTLEYKFLITSRSYHWTKNFQNFNEQADTS

SEQ ID NO: 10987 - protein, 428 aa, Homo Sapiens; identical to SEQ ID NO: 10985

SEQ ID NO: 10988 - protein, 91 aa, Homo Sapiens
MKDLYHYITSYVVDGQIIIYGPAYSGRETVYSNASLLIQNVTREDAGSYTLHIVKRGDGTRGETGHFTFTLYRHSLDSALSLEVTGSSQPL

SEQ ID NO: 10989 - protein, 326 aa, Homo Sapiens
MGPLSAPPCTQRITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLHGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 10990 - protein, 419 aa, Homo Sapiens
MGPLSAPPCTQRITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLSKPYITINNLNPRENKDVLTFTCEPKSKNYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 10991 - protein, 326 aa, Homo Sapiens
MGPLSAPPCTQRITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHPKLSKPYITINNLNPRENKDVLTFTCEPKSKNYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 10992 - protein, 52 aa, Homo Sapiens
MGPLSAPPCTQRITWKGVLLTGCSCPKPTGPSLYLVSQSILQDPMNVKYGTQ

SEQ ID NO: 10993 - protein, 40 aa, Homo Sapiens
MGPLSAPPCTQRITWKGVLLTGHSLDSALSLEVTGSSQSP

SEQ ID NO: 10994 - protein, 180 aa, Homo Sapiens
MGPLSAPPCTQRITWKGVLLTVETPKPSISSSNLNPREAMEAVILTCDPATPAASYQWWMNGQSLPMTHRLQLSKTNRTLFIFGVTKYIAGPYECEIRNPVSASRSDPVTLNLLHGPDLPSIYPSFTYYRSGENLYLSCFAESNPRAQYSWTINGKFQLSGQKLSIPQITTKHSGLYACS

SEQ ID NO: 10995 - protein, 292 aa, Homo Sapiens
MGPLSAPPCTQRITWKGVLLTVETPKPSISSSNLNPREAMEAVILTCDPATPAASYQWWMNGQSLPMTHRLQLSKTNRTLFIFGVTKYIAGPYECEIRNPVSASRSDPVTLNLLPKLSKPYITINNLNPRENKDVLTFTCEPKSKNYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVS

SEQ ID NO: 10996 - protein, 252 aa, Homo Sapiens
MKHCPQQETSTIGGKKKHPEGGDPENSHIYRSLPPVPASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLL

SEQ ID NO: 10997 - protein, 78 aa, Homo Sapiens
MTYLYHYITSYVVDGQRIIYGPAYSGRERVYSNASLLIQNVTQEDAGSYTLHIIKRRDGTGGVTGHFTFTLHLETPKP

SEQ ID NO: 10998 - protein, 96 aa, Homo Sapiens
  misc_feature (1)..(1): Xaa can be any naturally occurring amino acid
XETPKPSISSSNLNPREAMEAVILTCDPATPAASYQWWMNGQSLPMTHRLQLSKTNRTLFIFGVTKYIAGPYECEIRNPVSASRSDPVTLNLLRSY

SEQ ID NO: 10999 - protein, 244 aa, Homo Sapiens
  misc_feature (1)..(1): Xaa can be any naturally occurring amino acid
XSLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHPKLSKPYITINNLNPRENKDVLTFTCEPKSKNYTYIWWLNGQSLPVSPRVKRPIENRILILPNVTRNETGPYQCEIRDRYGGIRSDPVTLNVLYGPDLPSIYPSFTYYRSGENLYLSCFAES

SEQ ID NO: 11000 - protein, 258 aa, Homo Sapiens
  misc_feature (1)..(1): Xaa can be any naturally occurring amino acid
XYIAGPYECEIRNPVSASRSDPVTLNLLPKLSKPYITINNLNPRENKDVLTFTCEPKSKNYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSGHISNHWLYYQGFDWDVIFKNIDRMNQYELQAKSEVSLGLASYSQGFCKSLI

SEQ ID NO: 11001 - protein, 428 aa, Homo Sapiens
MGPLSAPPCTQHITWKGLLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYLETPKPSISSSNLNPREAMEAVILTCDPAASDTSYLWWMNGQSLPMTHRLQLSKTNRTLFIFGVTKYIAGPYECEIRNPVSASHSDPVTLNLLLKLPKPYITINNSKPRENKDVLAFTCEPKSENYTYIWWLNGQSLPVSPRVKRPIENRILILPSVTRNETGPYECEIRDRDGGMRSDPVTLNVLYGPDLPSIYPSFTYYRSGENLYLSCFAESNPPAEYFWTINGKFQQSGQKLSIPQITTKHRGLYTCSVRNSATGKESSKSMTVEVSAPSGIGRLPLLNPI

SEQ ID NO: 11002 - protein, 335 aa, Homo Sapiens
MGPLSAPPCTQHITWKGLLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYLKLPKPYITINNSKPRENKDVLAFTCEPKSENYTYIWWLNGQSLPVSPRVKRPIENRILILPSVTRNETGPYECEIRDRDGGMRSDPVTLNVLYGPDLPSIYPSFTYYRSGENLYLSCFAESNPPAEYFWTINGKFQQSGQKLSIPQITTKHRGLYTCSVRNSATGKESSKSMTVEVSAPSGIGRLPLLNPI

SEQ ID NO: 11003 - protein, 335 aa, Homo Sapiens; identical to SEQ ID NO: 11002

SEQ ID NO: 11004 - protein, 333 aa, Homo Sapiens
MGPLSAPPCTQHITWKGLLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYLKLPKPYITINNSKPRENKDVLAFTCEPKSENYTYIWWLNGQSLPVSPRVKRPIENRILILPSVTRNETGPYECEIRDRDGGMRSDPVTLNVLYGPDLPSIYPSFTYYRSGENLYLSCFAESNPPAEYFWTINGKFQQSGQKLSIPQITTKHRGLYTCSVRNSATGKESSKSMTVEVSGKWIPASLAIGF

SEQ ID NO: 11005 - protein, 335 aa, Homo Sapiens; identical to SEQ ID NO: 11002

SEQ ID NO: 11006 - protein, 157 aa, Homo Sapiens
MGPLSAPPCTQHITWKGLLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYPPSGIGRLPLLNPI

SEQ ID NO: 11007 - protein, 158 aa, Homo Sapiens [sequence omitted]

SEQ ID NO: 11008 - protein, 331 aa, Homo Sapiens
MGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLHGPDLPRIYPSFTYYRSGENLDLSCFADSNPPAEYSWTINGKFQLSGQKLFIPQITTNHSGLYACSVRNSATGKEISKSMIVKVSGPCHGNQTESH

SEQ ID NO: 11009 - protein, 424 aa, Homo Sapiens
MGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLPKLPMPYITINNLNPREKKDVLAFTCEPKSRNYTYIWWLNGQSLPVSPRVKRPIENRILILPSVTRNETGPYQCEIRDRYGGIRSNPVTLNVLYGPDLPRIYPSFTYYRSGENLDLSCFADSNPPAEYSWTINGKFQLSGQKLFIPQITTNHSGLYACSVRNSATGKEISKSMIVKVSGPCHGNQTESH

SEQ ID NO: 11010 - protein, 435 aa, Homo Sapiens
MGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLPKLPMPYITINNLNPREKKDVLAFTCEPKSRNYTYIWWLNGQSLPVSPRVKRPIENRILILPSVTRNETGPYQCEIRDRYGGIRSNPVTLNVLYGPDLPRIYPSFTYYRSGENLDLSCFADSNPPAEYSWTINGKFQLSGQKLFIPQITTNHSGLYACSVRNSATGKEISKSMIVKVSETASPQVTYAGPNTWFQEILLL

SEQ ID NO: 11011 - protein, 73 aa, Homo Sapiens
MTDLYHYITSYVVHGQIIYGPAYSGRETVYSNASLLIQNVTQEDAGSYTLHIIKRGDGTGGVTGYFTVTLYCE

SEQ ID NO: 11012 - protein, 81 aa, Homo Sapiens
  misc_feature (1)..(1): Xaa can be any naturally occurring amino acid
XEAVRLICDPETPDASYLWLLNGQNLPMTHRLQLSKTNRTLYLFGVTKYIAGPYECEIRNPVSASRSDPVTLNLLRGRCQL

SEQ ID NO: 11013 - protein, 419 aa, Homo Sapiens
MGPLSAPPCTQHITWKGLLLTASLLNFWNPPTTAQVTIEAQPPKVSEGKDVLLLVHNLPQNLTGYIWYKGQIRDLYHYVTSYIVDGQIIKYGPAYSGRETVYSNASLLIQNVTQEDTGSYTLHIIKRGDGTGGVTGRFTFTLYLETPKPSISSSNFNPREATEAVILTCDPETPDASYLWWMNGQSLPMTHSLQLSETNRTLYLFGVTNYTAGPYECEIRNPVSASRSDPVTLNLLPKLPKPYITINNLNPRENKDVSTFTCEPKSENYTYIWWLNGQSLPVSPRVKRRIENRILILPSVTRNETGPYQCEIRDRYGGIRSDPVTLNVLYGPDLPRIYPSFTYYHSGQNLYLSCFADSNPPAQYSWTINGKFQLSGQKLSIPQITTKHSGLYACSVRNSATGKESSKSVTVRVSDWTLP

SEQ ID NO: 11014 - protein, 426 aa, Homo Sapiens
MGPLSAPPCTQHITWKGLLLTASLLNFWNPPTTAQVTIEAQPPKVSEGKDVLLLVHNLPQNLTGYIWYKGQIRDLYHYVTSYIVDGQIIKYGPAYSGRETVYSNASLLIQNVTQEDTGSYTLHIIKRGDGTGGVTGRFTFTLYLETPKPSISSSNFNPREATEAVILTCDPETPDASYLWWMNGQSLPMTHSLQLSETNRTLYLFGVTNYTAGPYECEIRNPVSASRSDPVTLNLLPKLPKPYITINNLNPRENKDVSTFTCEPKSENYTYIWWLNGQSLPVSPRVKRRIENRILILPSVTRNETGPYQCEIRDRYGGIRSDPVTLNVLYGPDLPRIYPSFTYYHSGQNLYLSCFADSNPPAQYSWTINGKFQLSGQKLSIPQITTKHSGLYACSVRNSATGKESSKSVTVRVSGKWIPASLAIGF

SEQ ID NO: 11015 - protein, 297 aa, Homo Sapiens
MGPLSAPPCTQHITWKGLLLTVETPKPSISSSNFNPREATEAVILTCDPETPDASYLWWMNGQSLPMTHSLQLSETNRTLYLFGVTNYTAGPYECEIRNPVSASRSDPVTLNLLPKLPKPYITINNLNPRENKDVSTFTCEPKSENYTYIWWLNGQSLPVSPRVKRRIENRILILPSVTRNETGPYQCEIRDRYGGIRSDPVTLNVLYGPDLPRIYPSFTYYHSGQNLYLSCFADSNPPAQYSWTINGKFQLSGQKLSIPQITTKHSGLYACSVRNSATGKESSKSVTVRVSDWTLP

SEQ ID NO: 11016 - protein, 426 aa, Homo Sapiens
MGLLSAPPCTQRITWKGLLLTASLLNFWNPPTTAQVTIEAQPTKVSEGKDVLLLVHNLPQNLTGYIWYKGQIRDLYHYITSYVVDGQIIIYGPAYSGRETIYSNASLLIQNVTQEDAGSYTLHIIMGGDENRGVTGHFTFTLYLETPKPSISSSKLNPREAMEAVSLTCDPETPDASYLWWMNGQSLPMSHRLQLSETNRTLFLLGVTKYTAGPYECEIRNPVSASRSDPFTLNLLPKLPKPYITINNLKPRENKDVLNFTCEPKSENYTYIWWLNGQSLPVSPRVKRPIENRILILPSVTRNETGPYQCEIRDQYGGIRSYPVTLNVLYGPDLPRIYPSFTYYRSGEVLYLSCSADSNPPAQYSWTINGKFQLSGQKLFIPQITTKHSGLYACSVRNSATGKESSKSMTVKVSGKRIPVSLAIGI

SEQ ID NO: 11017 - protein, 419 aa, Homo Sapiens
MGLLSAPPCTQRITWKGLLLTASLLNFWNPPTTAQVTIEAQPTKVSEGKDVLLLVHNLPQNLTGYIWYKGQIRDLYHYITSYVVDGQIIIYGPAYSGRETIYSNASLLIQNVTQEDAGSYTLHIIMGGDENRGVTGHFTFTLYLETPKPSISSSKLNPREAMEAVSLTCDPETPDASYLWWMNGQSLPMSHRLQLSETNRTLFLLGVTKYTAGPYECEIRNPVSASRSDPFTLNLLPKLPKPYITINNLKPRENKDVLNFTCEPKSENYTYIWWLNGQSLPVSPRVKRPIENRILILPSVTRNETGPYQCEIRDQYGGIRSYPVTLNVLYGPDLPRIYPSFTYYRSGEVLYLSCSADSNPPAQYSWTINGKFQLSGQKLFIPQITTKHSGLYACSVRNSATGKESSKSMTVKVSDWTLP

SEQ ID NO: 11018 - protein, 40 aa, Homo Sapiens
MGLLSAPPCTQRITWKGLLLTGHSLDSALSLEVTGSSQPL

SEQ ID NO: 11019 - protein, 297 aa, Homo Sapiens
MGLLSAPPCTQRITWKGLLLTVETPKPSISSSKLNPREAMEAVSLTCDPETPDASYLWWMNGQSLPMSHRLQLSETNRTLFLLGVTKYTAGPYECEIRNPVSASRSDPFTLNLLPKLPKPYITINNLKPRENKDVLNFTCEPKSENYTYIWWLNGQSLPVSPRVKRPIENRILILPSVTRNETGPYQCEIRDQYGGIRSYPVTLNVLYGPDLPRIYPSFTYYRSGEVLYLSCSADSNPPAQYSWTINGKFQLSGQKLFIPQITTKHSGLYACSVRNSATGKESSKSMTVKVSDWTLP

SEQ ID NO: 11020 - protein, 326 aa, Homo Sapiens
MGPLSAPPCTQHIKWKGVLLTASLLNFWNPPTTAQVTIEAQPTKVSEGKDVLLLVHNLPQNLTGYIWYKGQIRDLYHYITSYVVDGQIIIYGPAYSGRETIYSNASLLIQNVTQEDAGSYTLHIIMGGDENRGVTGHFTFTLYPKLPKPYITINNLKPRENKDVLNFTCEPKSENYTYIWWLNGQSLPVSPRVKRPIENRILILPSVTRNETGPYQCEIRDQYGGIRSYPVTLNVLYGPDLPRIYPSFTYYRSGEVLYLSCSADSNPPAQYSWTINGKFQLSGQKLFIPQITTKHSGLYACSVRNSATGKESSKSMTVKVSDWTLP

SEQ ID NO: 11021 - protein, 402 aa, Homo Sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLHGPDLPRIYPSFTYYRSGENLDLSCFTESNPPAEYFWTINGKFQQSGQKLFIPQITRNHSGLYACSVHNSATGKEISKSMTVKVSGKWIPASLAVGFYVESIWLSEKSQENIFIPSLCPMGTSKSQILLLNPPNLSLQTLFSLFFCFLMADLVSGLKKVGRGLYQP

SEQ ID NO: 11022 - protein, 333 aa, Homo Sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLHGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 11023 - protein, 426 aa, Homo Sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 11024 - protein, 419 aa, Homo Sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSDWILP

SEQ ID NO: 11025 - protein, 326 aa, Homo Sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYSKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSDWILP

SEQ ID NO: 11026 - protein, 333 aa, Homo Sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYSKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 11027 - protein, 309 aa, Homo Sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYYGPDLPRIYPSFTYYRSGENLDLSCFTESNPPAEYFWTINGKFQQSGQKLFIPQITRNHSGLYACSVHNSATGKEISKSMTVKVSGKWIPASLAVGFYVESIWLSEKSQENIFIPSLCPMGTSKSQILLLNPPNLSLQTLFSLFFCFLMADLVSGLKKVGRGLYQP

SEQ ID NO: 11028 - protein, 240 aa, Homo Sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 11029 - protein, 953 aa, Homo Sapiens [sequence omitted]

SEQ ID NO: 11030 - protein, 953 aa, Homo Sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 11031 - protein, 922 aa, Homo Sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 11032 - protein, 922 aa, Homo Sapiens; identical to SEQ ID NO: 11031

SEQ ID NO: 11033 - protein, 203 aa, Homo Sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIGNYRLSAKCIDHYTKQCVENADLPEGEKKPIDQRLEGIVNKMFQRCLDDHKYKQAIGIALETRRLDVFEKTILESNDVPGMLAYSLKLCMSLMQNKQFRNKV

SEQ ID NO: 11034 - protein, 48 aa, Homo Sapiens
MITSAAGIISLLDEDEPQLKEFALHKLNAVVNDFWAEISESVDKIKMH

SEQ ID NO: 11035 - protein, 164 aa, Homo Sapiens
  misc_feature (1)..(1): Xaa can be any naturally occurring amino acid
XAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQNLRTVGTPIASVPGSTNTGTVPGSEKDSDSMETEEKTSSAFVGKTP

SEQ ID NO: 11036 - protein, 192 aa, Homo Sapiens
  misc_feature (1)..(1): Xaa can be any naturally occurring amino acid
XGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKVKPTANGVSSFLAPDCFPSPQNLCNSCKNTSAM

SEQ ID NO: 11037 - protein, 136 aa, Homo Sapiens
MILNWKLLGILVLCLHTRGISGSEGHPSHPPAEDREEAGSPTLPQGPPVPGDPWPGAPPLFEDPPPTRPSRPWRDLPETGVWLPEPPRTDPPQPPRPDDPWPAGPQPPENPWPPAPEVDNRPQEEPDLDPPREEYR

SEQ ID NO: 11038 - protein, 164 aa, Homo Sapiens
MAVGKFLLGSLLLLSLQLGQGWGPDARGVPVADGEFSSEQVAKAGGTWLGKDFQGPSVTSQLSPALTLLTVSALPSHRHPPPPCPPAPSPVWSMPAVEPDPVRGRARPGLRLRGEGHLPLLRRQLPPWCPHPAWPGAGPAAGPGPSPRRALLPAHSLHRRGLPR

SEQ ID NO: 11039 - protein, 156 aa, Homo Sapiens
MAVGKFLLGSLLLLSLQLGQGWGPDARGVPVADGEFSSEQVAKAGGTWLGTHRPLARLRRALSGPCQLWSLTLSVAELGLGYASEEKVIFRYCAGSCPRGARTQHGLALARLQGQGRAHGGPCCRPTRYTDVAFLDDRHRWQRLPQLSAAACGCGG

SEQ ID NO: 11040 - protein, 48 aa, Homo Sapiens
MATHHTLWMGLALLGVLGDLQAAPEAQVSVQPNFQQDKFLGRWFSAGL

SEQ ID NO: 11041 - protein, 190 aa, Homo Sapiens
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPHWGSTYSVSVVETDYDQYALLYSQGSKGPGEDFRMATLYSRTQTPRAELKEKFTAFCKAQGFTEDTIVFLPQTDKCMTEQ

SEQ ID NO: 11042 - protein, 195 aa, Homo Sapiens
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPREWGLHRPPGPSLGATLAGTTLGQPPAAEIHGVGDWGSTYSVSVVETDYDQYALLYSQGSKGPGEDFRMATLYSRTQTPRAELKE

SEQ ID NO: 11043 - protein, 124 aa, Homo Sapiens
VVAPATDGGLNLTSTFLRKNQCETRTMLLQPAGSLGSYSYRSPHWGSTYSVSVVETDYDQYALLYSQGSKGPGEDFRMATLYSRTQTPRAELKEKFTAFCKAQGFTEDTIVFLPQTAPGFFLGR

SEQ ID NO: 11044 - protein, 62 aa, Homo Sapiens
  misc_feature (1)..(1): Xaa can be any naturally occurring amino acid
XGYHCLPAPNRAQGEVGGDGGSVQFGGSVKTSSALREEQEAQWENWPKSGVLTTAPGFFLGR

SEQ ID NO: 11045 - protein, 386 aa, Homo Sapiens [sequence omitted]

SEQ ID NO: 11046 - protein, 296 aa, Homo Sapiens
MADSCRNLTYVRGSVGPATSTLMFVAGVVGNGLALGILSARRPARPSAFAVLVTGLAATDLLGTSFLSPAVFVAYARNSSLLGLARGGPALCDAFAFAMTFFGLASMLILFAMAVERCLALSHPYLYAQLDGPRCARLALPAIYAFCVLFCALPLLGLGQHQQYCPGSWCFLRMRWAQPGGAAFSLAYAGLVALLVAAIFLCNGSVTLSLCRMYRQQKRHQGSLGPRPRTGEDEVDHLILLALMTVVMAVCSLPLTHVERPRQDRMRWLTPVIPALWEAEAGGSFEVRSSRPVWPT

SEQ ID NO: 11047 - protein, 115 aa, Homo Sapiens
MGDLLAFRFYAFNPILDPWVFILFRKAVFQRLKLWVCCLCLGPAHGDSQTPLSQLASGRRDPRAPSAPVGKEGSCVPLSAWGEGQVEPLPPTQQSSGSAVGTSSKAEASVACSLC

SEQ ID NO: 11048 - protein, 143 aa, Homo Sapiens
MTVVMAVCSLPLTIRCFTQAVAPDSSSEMGDLLAFRFYAFNPILDPWVFILFRKAVFQRLKLWVCCLCLGPAHGDSQTPLSQLASGRRDPRAPSAPVGKEGSCVPLSAWGEGQVEPLPPTQQSSGSAVGTSSKAEASVACSLC

SEQ ID NO: 11049 - protein, 174 aa, Homo Sapiens
MYRQQKRHQGSLGPRPRTGEDEVDHLILLALMTVVMAVCSLPLTIRCFTQAVAPDSSSEMGDLLAFRFYAFNPILDPWVFILFRKAVFQRLKLWVCCLCLGPAHGDSQTPLSQLASGRRDPRAPSAPVGKEGSCVPLSAWGEGQVEPLPPTQQSSGSAVGTSSKAEASVACSLC

SEQ ID NO: 11050 - protein, 490 aa, Homo Sapiens
MLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 11051 - protein, 402 aa, Homo Sapiens
MLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPST

SEQ ID NO: 11052 - protein, 537 aa, Homo Sapiens
MRKPRLMNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 11053 - protein, 172 aa, Homo Sapiens
MSRSLLLWFLLFLLLLPPLPVLLADPGAPTPAGLWTWLRNSLRPSPSFTHFLLTHGRWFWEFVNATFIREMLMRLVLTVRSNLIPSPPTYNSAHDYISWESFSNFFKTSGKMGPGFTKALGHGVDLGHIYGDNLERQYQLRLFKDGKLKYQVLDGEMYPPSVEEAPVLMHYP

SEQ ID NO: 11054 - protein, 41 aa, Homo Sapiens
MSRSLLLWFLLFLLLLPPLPVLLADPGAPTPAPGHLCPLRP

SEQ ID NO: 11055 - protein, 551 aa, Homo Sapiens
MSRSLLLWFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 11056 - protein, 562 aa, Homo Sapiens
MSRSLLLWFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 11057 - protein, 599 aa, Homo Sapiens
MSRSLLLWFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 11058 - protein, 599 aa, Homo Sapiens; identical to SEQ ID NO: 11057

SEQ ID NO: 11059 - protein, 163 aa, Homo Sapiens
MLARALLLCAVLALSHTANPCCSHPCQNRGVCMSVGFDQYKCDCTRTGFYGENCSTPEFLTRIKLFLKPTPNTVHYILTHFKGFWNVVNNIPFLRNAIMSYVLTSRSHLIDSPPTYNADYGYKSWEAFSNLSYYTRALPPVPDDCPTPLGVKALHASVFQDRS

SEQ ID NO: 11060 - protein, 604 aa, Homo Sapiens
MLARALLLCAVLALSHTANPCCSHPCQNRGVCMSVGFDQYKCDCTRTGFYGENCSTPEFLTRIKLFLKPTPNTVHYILTHFKGFWNVVNNIPFLRNAIMSYVLTSRSHLIDSPPTYNADYGYKSWEAFSNLSYYTRALPPVPDDCPTPLGVKGKKQLPDSNEIVEKLLLRRKFIPDPQGSNMMFAFFAQHFTHQFFKTDHKRGPAFTNGLGHGVDLNHIYGETLARQRKLRLFKDGKMKYQIIDGEMYPPTVKDTQAEMIYPPQVPEHLRFAVGQEVFGLVPGLMMYATIWLREHNRVCDVLKQEHPEWGDEQLFQTSRLILIGETIKIVIEDYVQHLSGYHFKLKFDPELLFNKQFQYQNRIAAEFNTLYHWHPLLPDTFQIHDQKYNYQQFIYNNSILLEHGITQFVESFTRQIAGRVAGGRNVPPAVQKVSQASIDQSRQMKYQSFNEYRKRFMLKPYESFEELTGEKEMSAELEALYGDIDAVELYPALLVEKPRPDAIFGETMVEVGAPFSLKGLMGNVICSPAYWKPSTFGGEVGFQIINTASIQSLICNNVKGCPFTSFSVPDPELIKTVTINASSSRSGLDDINPTVLLKERSTEL

SEQ ID NO: 11061 - protein, 115 aa, Homo Sapiens
MIPAKDMAKVMIVMLAICFLTKSDGKSVKKRSVSEIQLMHNLGKHLNSMERVEWLRKKLQDVHNFVALGAPLAPRDAGSQRPRKKEDNVLVESHEKSLGEADKADVNVLTKAKSQ

SEQ ID NO: 11062 - protein, 115 aa, Homo Sapiens; identical to SEQ ID NO: 11061

SEQ ID NO: 11063 - protein, 100 aa, Homo Sapiens
METRQVSRSPRVRLLLLLLLLLVVPWGVRTASGVALPPVGVLSLRPPGRAWADPATPRPRRSLALADDAAFRERARLLAALERRHWLNSYMHKLLVLDAP

SEQ ID NO: 11064 - protein, 172 aa, Homo Sapiens
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLEL

SEQ ID NO: 11065 - protein, 175 aa, Homo Sapiens
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSR

SEQ ID NO: 11066 - protein, 175 aa, Homo Sapiens; identical to SEQ ID NO: 11065

SEQ ID NO: 11067 - protein, 175 aa, Homo Sapiens; identical to SEQ ID NO: 11065

SEQ ID NO: 11068 - protein, 177 aa, Homo Sapiens
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSRRH

SEQ ID NO: 11069 - protein, 177 aa, Homo Sapiens; identical to SEQ ID NO: 11068

SEQ ID NO: 11070 - protein, 177 aa, Homo Sapiens; identical to SEQ ID NO: 11068

SEQ ID NO: 11071 - protein, 209 aa, Homo Sapiens
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSRTALLWGLKKKKENNRRTHHMQLMISLFKSPLLLL

SEQ ID NO: 11072 - protein, 111 aa, Homo Sapiens
MSRARAETMQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRY

SEQ ID NO: 11073 - protein, 269 aa, Homo Sapiens
FSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVASEHLCPEGQGEVEGNTGLGVMDRGFPAVPSWLKKPQDSQLEEGKPGYLDCLTQATPKPTVVWYRNQMLISEDSRFEVFKNGTLRINSVEVYDGTWYRCMSSTPAGSI

SEQ ID NO: 11074 - protein, 139 aa, Homo Sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKCESQGGCAQSPCQTLND

SEQ ID NO: 11075 - protein, 157 aa, Homo Sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPR

SEQ ID NO: 11076 - protein, 1070 aa, Homo Sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 11077 - protein, 816 aa, Homo Sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGRPQAVPEDFQEQG

SEQ ID NO: 11078 - protein, 940 aa, Homo Sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVANGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 11079 - protein, 1030 aa, Homo Sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLDGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 11080 - protein, 1014 aa, Homo Sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 11081 - protein, 459 aa, Homo Sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVASEHLCPEGQGEVEGNTGLGVMDRGFPGTHLRSSQFWALQAWESVHYWESV

SEQ ID NO: 11082 - protein, 1078 aa, Homo Sapiens
MGSFLSGEKRPSAPTVGSAMEKKEFPTPPGRVGPGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 11083 - protein, 257 aa, Homo Sapiens
MVARVSGLIVTLLSSSFPGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDV

SEQ ID NO: 11084 - protein, 84 aa, Homo Sapiens
MVARVSGLIVTLLSSSFPGGPLQNGQPSAEIQEEVALTSLGSGPAATNKRHSTSDKMHFPRSSLQPITTLGRPQAVPEDFQEQG

SEQ ID NO: 11085 - protein, 25 aa, Homo Sapiens
TEHGTEAIFVAAVGIRPSHHAAAQS

SEQ ID NO: 11086 - protein, 25 aa, Homo Sapiens
TEHGTEAIFVAAVGIRPSHHAAAQS

SEQ ID NO: 11087 - protein, 365 aa, Homo Sapiens
  misc_feature (1)..(1): Xaa can be any naturally occurring amino acid
XEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 11088 - protein, 25 aa, Homo Sapiens
  misc_feature (1)..(1): Xaa can be any naturally occurring amino acid
XEHGTEAIFVAAVGIRPSHHAAAQS

SEQ ID NO: 11089 - protein, 168 aa, Homo Sapiens
MQAQQYQQQRRKFAAAFLAFIFILAAVDTAEAGKKEKPEKKVKKSDCGEWQWSVCVPTSGDCGLGTREGTRTGAECKQTMKTQRCKIPCNWKKQFGAECKYQFQAWGECDLNTALKTRTGSLKRALHNAECQKTVTISKPCGKLTKPKPQAESKKKKKEGKKQEKMLD

SEQ ID NO: 11090 - protein, 166 aa, Homo Sapiens
MQAQQYQQQRRKFAAAFLAFIFILAAVDTAEAGKKEKPEKKVKKSDCGEWQWSVCVPTSGDCGLGTREGTRTGAECKQTMKTQRCKIPCNWKKQFGAECKYQFQAWGECDLNTALKTRTGSLKRALHNAECQKTVTISKPCGKLTKPKPQEKGKWRHRSGESLRRW

SEQ ID NO: 11091 - protein, 138 aa, Homo Sapiens
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPS

SEQ ID NO: 11092 - protein, 253 aa, Homo Sapiens
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSDETPIIAVMVALSSLLVIVFIIIVLYMLRFKKYKQAGSHSNSFRLSNGRTEDVEPQSVPLLARSPSTNRKYPPLPVDKLEEEINRRMADDNKLFREEFNALPACPIQATCEAASK

SEQ ID NO: 11093 - protein, 793 aa, Homo Sapiens
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSDETPIIAVMVALSSLLVIVFIIIVLYMLRFKKYKQAGSHSNSFRLSNGRTEDVEPQSVPLLARSPSTNRKYPPLPVDKLEEEINRRMADDNKLFREEFNALPACPIQATCEAASKEENKEKNRYVNILPYDHSRVHLTPVEGVPDSDYINASFINGYQEKNKFIAAQGPKEETVNDFWRMIWEQNTATIVMVTNLKERKECKCAQYWPDQGCWTYGNIRVSVEDVTVLVDYTVRKFCIQQVGDMTNRKPQRLITQFHFTSWPDFGVPFTPIGMLKFLKKVKACNPQYAGAIVVHCSAGVGRTGTFVVIDAMLDMMHTERKVDVYGFVSRIRAQRCQMVQTDMQYVFIYQALLEHYLYGDTELEVTSLETHLQKIYNKIPGTSNNGLEEEFKKLTSIKIQNDKMRTGNLPANMKKNRVLQIIPYEFNRVIIPVKRGEENTDYVNASFIDGYRQKDSYIASQGPLLHTIEDFWRMIWEWKSCSIVMLTELEERGQEKCAQYWPSDGLVSYGDITVELKKEEECESYTVRDLLVTNTRENKSRQIRQFHFHGWPEVGIPSDGKGMISIIAAVQKQQQQSGNHPITVHCSAGAGRTGTFCALSTVLERVKAEGILDVFQTVKSLRLQRPHMVQTLEQYEFCYKVVQEYIDAFSDYANFK

SEQ ID NO: 11094 - protein, 793 aa, Homo Sapiens; identical to SEQ ID NO: 11093

SEQ ID NO: 11095 - protein, 793 aa, Homo Sapiens; identical to SEQ ID NO: 11093

SEQ ID NO: 11096 - protein, 175 aa, Homo Sapiens
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSGNSDSKDRRDETPIIAVMVALSSLLVIVFIIIVLYML

SEQ ID NO: 11097 - protein, 802 aa, Homo Sapiens
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSGNSDSKDRRDETPIIAVMVALSSLLVIVFIIIVLYMLRFKKYKQAGSHSNSFRLSNGRTEDVEPQSVPLLARSPSTNRKYPPLPVDKLEEEINRRMADDNKLFREEFNALPACPIQATCEAASKEENKEKNRYVNILPYDHSRVHLTPVEGVPDSDYINASFINGYQEKNKFIAAQGPKEETVNDFWRMIWEQNTATIVMVTNLKERKECKCAQYWPDQGCWTYGNIRVSVEDVTVLVDYTVRKFCIQQVGDMTNRKPQRLITQFHFTSWPDFGVPFTPIGMLKFLKKVKACNPQYAGAIVVHCSAGVGRTGTFVVIDAMLDMMHTERKVDVYGFVSRIRAQRCQMVQTDMQYVFIYQALLEHYLYGDTELEVTSLETHLQKIYNKIPGTSNNGLEEEFKKLTSIKIQNDKMRTGNLPANMKKNRVLQIIPYEFNRVIIPVKRGEENTDYVNASFIDGYRQKDSYIASQGPLLHTIEDFWRMIWEWKSCSIVMLTELEERGQEKCAQYWPSDGLVSYGDITVELKKEEECESYTVRDLLVTNTRENKSRQIRQFHFHGWPEVGIPSDGKGMISIIAAVQKQQQQSGNHPITVHCSAGAGRTGTFCALSTVLERVKAEGILDVFQTVKSLRLQRPHMVQTLEQYEFCYKVVQEYIDAFSDYANFK

SEQ ID NO: 11098 - protein, 802 aa, Homo Sapiens; identical to SEQ ID NO: 11097

SEQ ID NO: 11099 - protein, 1407 aa, Homo Sapiens
MEAEFYMVILTCLIFRNSEGFQIVHVQKQQCLFKNEKVVVGSCNRTIQNQQWMWTEDEKLLHVKSALCLAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYN

SEQ ID NO: 11100 - protein, 2215 aa, Homo Sapiens
MEAEFYMVILTCLIFRNSEGFQIVHVQKQQCLFKNEKVVVGSCNRTIQNQQWMWTEDEKLLHVKSALCLAISNSSRGPSRSAILDRCSQAPRWTCYDQEGFLEVENASLFLQKQGSRVVVKKARKYLHSWMKIDVNKEGKLVNESLCLQKAGLGAEVSVRSTRNTAPPQILTTFNAVPDGLVFLIRNTTEAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 11101 - protein, 2127 aa, Homo Sapiens
MEAEFYMVILTCLIFRNSEGFQIVHVQKQQCLFKNEKVVVGSCNRTIQNQQWMWTEDEKLLHVKSALCLAISNSSRGPSRSAILDRCSQAPRWTCYDQEGFLEVENASLFLQKQGSRVVVKKARKYLHSWMKIDVNKEGKLVNESLCLQKAGLGAEVSVRSTRNTAPPQILTTFNAVPDGLVFLIRNTTEAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 11102 - protein, 1583 aa, Homo Sapiens
MEAEFYMVILTCLIFRNSGFQIVHVQKQQCLFKNEKVVVGSCNRTIQNQQWMWTEDEKLLHVKSALCLAISNSSRGPSRSAILDRCSQAPRWTCYDQEGFLEVENASLFLQKQGSRVVVKKARKYLHSWMKIDVNKEGKLVNESLCLQKAGLGAEVSVRSTRNTAPPQILTTFNAVPDGLVFLIRNTTEAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTSMTCFATLISQME

SEQ ID NO: 11103 - protein, 1997 aa, Homo Sapiens
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 11104 - protein, 1907 aa, Homo Sapiens
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 11105 - protein, 1907 aa, Homo Sapiens
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 11106 - protein, 103 aa, Homo Sapiens
  misc_feature (1)..(1): Xaa can be any naturally occurring amino acid
XLWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTGKG

SEQ ID NO: 11107 - protein, 148 aa, Homo Sapiens
MTMYLWLKLLAFGFAFLDTEVFVTGQSPTPSPTDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLH

SEQ ID NO: 11108 - protein, 1145 aa, Homo Sapiens
MTMYLWLKLLAFGFAFLDTEVFVTGQSPTPSPTDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 11109 - protein, 87 aa, Homo Sapiens
MTMYLWLKLLAFGFAFLDTEVFVTGQSPTPSPTGHLQAEEQGSQSKSPNLKSREADSSAFSWWPKAREPLTNHWSKSKSPKAEELGV

SEQ ID NO: 11110 - protein, 151 aa, Homo Sapiens
MTMYLWLKLLAFGFAFLDTEVFVTGQSPTPSPTGHLQAEEQGSQSKSPNLKSREADSSAFSWWPKAREPLTNHWSVSSVQTPHLPTHADSQTPSAGTDTQTFSGSAANAKLNPTPGSNAISDAYLNASETTTLSPSGSAVISTTTIATTPS

SEQ ID NO: 11111 - protein, 36 aa, Homo Sapiens
MTMYLWLKLLAFGFAFLDTEVFVTGQSPTPSPTGKN

SEQ ID NO: 11112 - protein, 118 aa, Homo Sapiens
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTP

SEQ ID NO: 11113 - protein, 753 aa, Homo Sapiens
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVN

SEQ ID NO: 11114 - protein, 1306 aa, Homo Sapiens
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 11115 - protein, 161 aa, Homo Sapiens
MTMYLWLKLLAFGFAFLDTEVFVTGQSPTPSPTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTE

SEQ ID NO: 11116 - protein, 600 aa, Homo Sapiens
MTMYLWLKLLAFGFAFLDTEVFVTGQSPTPSPTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYID

SEQ ID NO: 11117 - protein, 735 aa, Homo Sapiens
MTMYLWLKLLAFGFAFLDTEVFVTGQSPTPSPTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVN

SEQ ID NO: 11118 - protein, 206 aa, Homo Sapiens
MALPCTLGLGMLLALPGALGSGGSAEDSVGSSSVTVVLLLLLLLLLATGLALAWRRLSRDSGGYYHPARLGAALWGRTRRLLWASPPGRWLQARAELGSTDNDLERQEDEQDTDYDHVADGGLQADPGEGEQQCGEASSPEQVPVRAEEARDSDTEGDLVLGSPGPASAGGSAEALLSDLHAFAGSAAWDDSARAAGGQGLHVTAL

SEQ ID NO: 11119 - protein, 93 aa, Homo Sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDE

SEQ ID NO: 11120 - protein, 1496 aa, Homo Sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSTVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 11121 - protein, 1505 aa, Homo Sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGALQIEQSEESDQGKYECVATNSAGTRYSAPANLYVRVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSMFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGSDDSGYPGNLHSSSMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 11122 - protein, 1506 aa, Homo Sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSMFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKSSKPDRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 11123 - protein, 1912 aa, Homo Sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 11124 - protein, 1912 aa, Homo Sapiens; identical to SEQ ID NO: 11123

SEQ ID NO: 11125 - protein, 1912 aa, Homo Sapiens; identical to SEQ ID NO: 11123

SEQ ID NO: 11126 - protein, 1505 aa, Homo Sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSMFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKSKPDRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 11127 - protein, 1502 aa, Homo Sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSMFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKSKPDRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 11128 - protein, 202 aa, Homo Sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGTDFSPSSLSLLLNGWSMFVMS

SEQ ID NO: 11129 - protein, 1505 aa, Homo Sapiens [sequence omitted]

SEQ ID NO: 11130 - protein, 297 aa, Homo Sapiens
  misc_feature (1)..(1): Xaa can be any naturally occurring amino acid
XAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKSKPDRKRAESDSRKSSIPNNKEIPSHHPTDPVELRRLNFQTPALSSNSVPYASLIGSVSSLSSQTTTQSIYDNNSLPRSARKGMASHPPIPILELA

SEQ ID NO: 11131 - protein, 262 aa, Homo Sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRGLAAWARSPMGIWSHPIRLLGVCACVCAHTGTLICV

SEQ ID NO: 11132 - protein, 262 aa, Homo Sapiens; identical to SEQ ID NO: 11131

SEQ ID NO: 11133 - protein, 1907 aa, Homo Sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQWRPEESEDYETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 11134 - protein, 1898 aa, Homo Sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 11135 - protein, 979 aa, Homo Sapiens
TYVRLENGEPRGLPIIQDVMLAEAQWRPEESEDYETTISGLTPETTYSVTVAAYTTKGDGARSKPKIVTTTGAVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGSSVPSCPNTSSMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 11136 - protein, 1553 aa, Homo Sapiens
  misc_feature (1)..(1): Xaa can be any naturally occurring amino acid
XEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 11137 - protein, 1332 aa, Homo Sapiens
  misc_feature (1)..(1): Xaa can be any naturally occurring amino acid
XSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSMPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGSSVPSCPNTSSMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 11138 - protein, 1291 aa, Homo Sapiens
  misc_feature (1)..(1): Xaa can be any naturally occurring amino acid
XSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSMPSGPPRKVEVEPLNSTAVHVYWKLPVPSKQHGQIRGYQVTYVRLENGEPRGLPIIQDVMLAEAQWRPEESEDYETTISGLTPETTYSVTVAAYTTKGDGARSKPKIVTTTGAVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGSSVPSCPNTSSMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 11139 - protein, 120 aa, Homo Sapiens
MKPAAREARLPPRSPGLRWALPLLLLLLRLGQILCAGGRPSPVFDIKAVSISPTNVILTWKSNDTAASEYKYVVKHKMENEKTITVVHQPWCNITGLRPATSYVFSITPGIGNETWGDPR

SEQ ID NO: 11140 - protein, 147 aa, Homo Sapiens [sequence omitted]

SEQ ID NO: 11141 - protein, 539 aa, Homo Sapiens
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTG

SEQ ID NO: 11142 - protein, 1337 aa, Homo Sapiens
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTVPSAVFDIHVVYVTTTEMWLDWKSPDGASEYVYHLVIESKHGSNHTSTYDKAITLQGLIPGTLYNITISPEVDHVWGDPNSTAQYTRPSNVSNIDVSTNTTAATLSWQNFDDASPTYSYCLLIEKAGNSSNATQVVTDIGITDATVTELIPGSSYTVEIFAQVGDGIKSLEPGRKSFCTDPASMASFDCEVVPKEPALVLKWTCPPGANAGFELEVSSGAWNNATHLESCSSENGTEYRTEVTYLNFSTSYNISITTVSCGKMAAPTRNTCTTGITDPPPPDGSPNITSVSHNSVKVKFSGFEASHGPIKAYAVILTTGEAGHPSADVLKYTYEDFKKGASDTYVTYLIRTEEKGRSQSLSEVLKYEIDVGNESTTLGYYNGKLEPLGSYRACVAGFTNITFHPQNKGLIDGAESYVSFSRYSDAVSLPQDPGVICGAVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 11143 - protein, 1342 aa, Homo Sapiens
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTVPSAVFDIHVVYVTTTEMWLDWKSPDGASEYVYHLVIESKHGSNHTSTYDKAITLQGLIPGTLYNITISPEVDHVWGDPNSTAQYTRPSNVSNIDVSTNTTAATLSWQNFDDASPTYSYCLLIEKAGNSSNATQVVTDIGITDATVTELIPGSSYTVEIFAQVGDGIKSLEPGRKSFCTDPASMASFDCEVVPKEPALVLKWTCPPGANAGFELEVSSGAWNNATHLESCSSENGTEYRTEVTYLNFSTSYNISITTVSCGKMAAPTRNTCTTGITDPPPPDGSPNITSVSHNSVKVKFSGFEASHGPIKAYAVILTTGEAGHPSADVLKYTYEDFKKGASDTYVTYLIRTEEKGRSQSLSEVLKYEIDVGNESTTLGYYNGKLEPLGSYRCLLRACVAGFTNITFHPQNKGLIDGAESYVSFSRYSDAVSLPQDPGVICGAVFGCIFGALVIVTVGGFIFWRKKRKDAKNNEVSFSQIKSLKRSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 11144 - protein, 1338 aa, Homo Sapiens [sequence omitted]

SEQ ID NO: 11145 - protein, 1216 aa, Homo Sapiens
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 11146 - protein, 1188 aa, Homo Sapiens
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 11147 - protein, 597 aa, Homo Sapiens
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVVIFP

SEQ ID NO: 11148 - protein, 405 aa, Homo Sapiens
MVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 11149 - protein, 405 aa, Homo Sapiens; identical to SEQ ID NO: 11148

SEQ ID NO: 11150 - protein, 377 aa, Homo Sapiens
MVTEMNPNVVVISVLAILSTLLIGLLLVTLIILRKKHLQMARECGAGTFVNFASLERDGKLPYNWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 11151 - protein, 377 aa, Homo Sapiens; identical to SEQ ID NO: 11150

SEQ ID NO: 11152 - protein, 116 aa, Homo Sapiens
WKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCR

SEQ ID NO: 11153 - protein, 88 aa, Homo Sapiens
  misc_feature (1)..(1): Xaa can be any naturally occurring amino acid
XVTLLWVEEGVADFFEVFCQQVGSSQKTKLQEPVAVSSHVVTISSLLPATAYNCSVTSFSHDSPSVPTFIAVSTMGSVELVHLSILHP

SEQ ID NO: 11154 - protein, 79 aa, Homo Sapiens
MAPTWGPGMVSVVGPMGLLVVLLVGGCAAEEPPRFIKEPKDQIGVSGGVASFVCQATGDPKPRVTWNKKGKKVNSQRFE

SEQ ID NO: 11155 - protein, 91 aa, Homo Sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVL

SEQ ID NO: 11156 - protein, 1948 aa, Homo Sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSETFESTPIRGALQIESSEETDQGKYECVATNSAGVRYSSPANLYVRELREVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQWETDDTAEYEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPDSGLRSPLREPGFHFESMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 11157 - protein, 1505 aa, Homo Sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRELREVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSISPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 11158 - protein, 1501 aa, Homo Sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSISPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKKKPHSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 11159 - protein, 1501 aa, Homo Sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSISPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 11160 - protein, 1910 aa, Homo Sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 11161 - protein, 128 aa, Homo Sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLRGP

SEQ ID NO: 11162 - protein, 142 aa, Homo Sapiens
MAPGVARGPTPYWRLRLGGAALLLLLIPVAAAQEPPGAACSQNTNKTCEECLKNVSACLKKKTRMLDLKTTKALQHISPDASCEVHAPQPSPAGRPRGHCGLLTLASEPASLPGQAAGELPLKDSPLVLQTGDLLFPVHLCF

SEQ ID NO: 11163 - protein, 107 aa, Homo Sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWGLFKEENPYARFENN

SEQ ID NO: 11164 - protein, 180 aa, Homo Sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 11165 - protein, 159 aa, Homo Sapiens
MGQAVSCVLGRLQPVKCTGARRVGRRGLRKQTSQECLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 11166 - protein, 381 aa, Homo Sapiens
MHLLAILFCALWSAVLAENSDDYDLMYVNLDNEIDNGLHPTEDPTPCACGQEHSEWDKLFIMLENSQMRERMLLQATDDVLRGELQRLREELGRLAESLARPCAPGAPAEARLTSALDELLQATRDAGRRLARMEGAEAQRPEEAGRALAAVLEELRQTRADLHAVQGWAARSWLPAGCETAILFPMRSKKIFGSVHPVRPMRLESFSACIWVKATDVLNKTILFSYGTKRNPYEIQLYLSYQSIVFVVGGEENKLVAEAMVSLGRWTHLCGTWNSEEGLTSLWVNGELAATTVEMATGHIVPEGGILQIGQEKNGCCVGGGFDETLAFSGRLTGFNIWDSVLSNEEIRETGGAESCHIRGNIVGWGVTEIQPHGGAQYVS

SEQ ID NO: 11167 - protein, 192 aa, Homo Sapiens
MGCSWRKTLSFFLVFVPIYLHGASSQEAAPVGPRKPFFERLRRLEEQFRRFQEVTWTHLQNIASNYNVSYNVDVRFRSLAEESQAVAQAVNRSQASVQGELAQLKAWVRKLQRRGRKFAAWAPPSFSQTPPPGTWSSSALVSSLPCEPCPSAAGSARPPAAWAPSCPTPPRTMTTSWCCTAETPCCPDPSTS

SEQ ID NO: 11168 - protein, 478 aa, Homo Sapiens
MGCSWRKTLSFFLVFVPIYLHGASSQEAAPVGPRKPFFERLRRLEEQFRRFQEVTWTHLQNIASNYNVSYNVDVRFRSLAEESQAVAQAVNRSQASVQGELAQLKAWVRKLQRRGRKVDTRLRALDLTLGERSQQRARERKAHKAQRDALQDSLARLEGLVHSQGARLAALEGRLPVAHPGTAALGPALVPTPTQPEELGPTSLKLQRDRQELRAASEHRGPPQDSSAPLQGRREPPASGSHRVLSGTAPKDPRQQAWSPQVPGEICGVGPTLVFPNASTRNVVFLSPGFVTALRALSFCSWVRTASGRLGTLLSYATEDNDNKLVLHGRDSLLPGSIHFVIGDPAFRELPLQLLLDGQWHHICVIWTSTQGRYWLHVDRRLVATGSRFREGYEIPPGGSLVLGQEQDSVGGGFDSSEAFVGSMSGLAIWDRALVPGEVANLAIGKEFPTGAILTLANAALAGGFVQGANCTCLERCP

SEQ ID NO: 11169 - protein, 473 aa, Homo Sapiens
MGSGNWEVTGPPCGSRCERPPGLPRGVHGQFRSAVGLSGLRWFRRFQEVTWTHLQNIASNYNVSYNVDVRFRSLAEESQAVAQAVNRSQASVQGELAQLKAWVRKLQRRGRKVDTRLRALDLTLGERSQQRARERKAHKAQRDALQDSLARLEGLVHSQGARLAALEGRLPVAHPGTAALGPALVPTPTQPEELGPTSLKLQRDRQELRAASEHRGPPQDSSAPLQGRREPPASGSHRVLSGTAPKDPRQQAWSPQVPGEICGVGPTLVFPNASTRNVVFLSPGFVTALRALSFCSWVRTASGRLGTLLSYATEDNDNKLVLHGRDSLLPGSIHFVIGDPAFRELPLQLLLDGQWHHICVIWTSTQGRYWLHVDRRLVATGSRFREGYEIPPGGSLVLGQEQDSVGGGFDSSEAFVGSMSGLAIWDRALVPGEVANLAIGKEFPTGAILTLANAALAGGFVQGANCTCLERCP

SEQ ID NO: 11170 - protein, 44 aa, Homo Sapiens
MARAMAAAWPLLLVALLVLSWPPPGTGAQHGGDACVTADLGAAW

SEQ ID NO: 11171 - protein, 364 aa, Homo Sapiens
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKGTEHASASANGHVSYSAVSRENSSSQDPQTEGTR

SEQ ID NO: 11172 - protein, 372 aa, Homo Sapiens
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGTEHASASANGHVSYSAVSRENSSSQDPQTEGTR

SEQ ID NO: 11173 - protein, 392 aa, Homo Sapiens
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGMSRNAIIFLVLGILVFLILLGIGIYFYWSKCSREVLWHCHLCPSSEHHQSCRN

SEQ ID NO: 11174 - protein, 417 aa, Homo Sapiens
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGMSRNAIIFLVLGILVFLILLGIGIYFYWSKCSREVLWHCHLCPSSTEHASASANGHVSYSAVSRENSSSQDPQTEGTR

SEQ ID NO: 11175 - protein, 70 aa, Homo Sapiens
  misc_feature (1)..(1): Xaa can be any naturally occurring amino acid
XCKVEHESFEKPQLLTVNLTVYYPPEVSISGYDNNWYLGQNEATLTCDARSNPEPTGYNWSTYRACQRLS

SEQ ID NO: 11176 - protein, 224 aa, Homo Sapiens
MAKRSRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRI

SEQ ID NO: 11177 - protein, 1479 aa, Homo Sapiens
MAKRSRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSYHYNDLVSPQYLNLIANLSGCTAHRRVNNCSDMCFHQKYRTHDGTCNNLQHPMWGASLTAFERLLKSVYENGFNTPRGINPHRLYNGHALPMPRLVSTTLIGTETVTPDEQFTHMLMQWGQFLDHDLDSTVVALSQARFSDGQHCSNVCSNDPPCFSVMIPPNDSRARSGARCMFFVRSSPVCGSGMTSLLMNSVYPREQINQLTSYIDASNVYGSTEHEARSIRDLASHRGLLRQGIVQRSGKPLLPFATGPPTECMRDENESPIPCFLAGDHRANEQLGLTSMHTLWFREHNRIATELLKLNPHWDGDTIYYETRKIVGAEIQHITYQHWLPKILGEVGMRTLGEYHGYDPGINAGIFNAFATAAFRFGHTLVNPLLYRLDENFQPIAQDHLPLHKAFFSPFRIVNEGGIDPLLRGLFGVAGKMRVPSQLLNTELTERLFSMAHTVALDLAAINIQRGRDHGIPPYHDYRVYCNLSAAHTFEDLKNEIKNPEIREKLKRLYGSTLNIDLFPALVVEDLVPGSRLGPTLMCLLSTQFKRLRDGDRLWYENPGVFSPAQLTQIKQTSLARILCDNADNITRVQSDVFRVAEFPHGYGSCDEIPRVDLRVWQDCCEDCRTRGQFNAFSYHFRGRRSLEFSYQEDKPTKKTRPRKIPSVGRQGEHLSNSTSAFSTRSDASGTNDFREFVLEMQKTITDLRTQIKKLESRLSTTECVDAGGESHANNTKWKKDACTICECKDGQVTCFVEACPPATCAVPVNIPGACCPVCLQKRAEEKP

SEQ ID NO: 11178 - protein, 197 aa, Homo Sapiens
  misc_feature (1)..(1): Xaa can be any naturally occurring amino acid
XGSWFPSAPGLSTTVLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNP

SEQ ID NO: 11179 - protein, 723 aa, Homo Sapiens
  misc_feature (1)..(1): Xaa can be any naturally occurring amino acid
XRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSQCQSLFFLLHGLSNGVEHASVKSHS

SEQ ID NO: 11180 - protein, 76 aa, Homo Sapiens
  misc_feature (1)..(1): Xaa can be any naturally occurring amino acid
XVQSDVFRVAEFPHGYGSCDEIPRVDLRVWQDCCEDCRTRGQFNAFSYHFRGRRSLEFSYQEDKPTKKTRPRKIPR

SEQ ID NO: 11181 - protein, 1463 aa, Homo Sapiens
MEPRLFCWTTLFLLAGWCLPGLPCPSRCLCFKSTVRCMHLMLDHIPQVPQQTTVLDLRFNRIREIPGSAFKKLKNLNTLLLNNNHIRKISRNAFEGLENLLYLYLYKNEIHALDKQTFKGLISLEHLYIHFNQLEMLQPETFGDLLRLERLFLHNNKLSKIPAGSFSNLDSLKRLRLDSNALVCDCDLMWLGELLQGFAQHGHTQAAATCEYPRRLHGRAVASVTVEEFNCQSPRITFEPQDVEVPSGNTVYFTCRAEGNPKPEIIWIHNNHSLDLEDDTRLNVFDDGTLMIRNTRESDQGVYQCMARNSAGEAKTQSAMLRYSSLPAKPSFVIQPQDTEVLIGTSTTLECMATGHPHPLITWTRDNGLELDGSRHVATSSGLYLQNITQRDHGRFTCHANNSHGTVQAAANIIVQAPPQFTVTPKDQVVLEEHAVEWLCEADGNPPPVIVWTKTGGQLPVEGQHTVLSSGTLRIDRAAQHDQGQYECQAVSSLGVKKVSVQLTVKPKALAVFTQLPQDTSVEVGKNINISCHAQGEPQPIITWNKEGVQITESGKFHVDDEGTLTIYDAGFPDQGRYECVARNSFGLAVTNMFLTVTAIQGRQAGDDFVESSILDAVQRVDSAINSTRRHLFSQKPHTSSDLLAQFHYPRDPLIVEMARAGEIFEHTLQLIRERVKQGLTVDLEGKEFRYNDLVSPRSLSLIANLSGCTARRPLPNCSNRCFHAKYRAHDGTCNNLQQPTWGAALTAFARLLQPAYRDGIRAPRGLGLPVGSRQPLPPPRLVATVWARAAAVTPDHSYTRMLMHWGWFLEHDLDHTVPALSTARFSDGRPCSSVCTNDPPCFPMNTRHADPRGTHAPCMLFARSSPACASGRPSATVDSVYAREQINQQTAYIDGSNVYGSSERESQALRDPSVPRGLLKTGFPWPPSGKPLLPFSTGPPTECARQEQESPCFLAGDHRANEHLALAAMHTLWFREHNRMATELSALNPHWEGNTVYQEARKIVGAELQHITYSHWLPKVLGDPGTRMLRGYRGYNPNVNAGIINSFATAAFRFGHTLINPILYRLNATLGEISEGHLPFHKALFSPSRIIKEGGIDPVLRGLFGVAAKWRAPSYLLSPELTQRLFSAAYSAAVDSAATIIQRGRDHGIPPYVDFRVFCNLTSVKNFEDLQNEIKDSEIRQKLRKLYGSPGDIDLWPALMVEDLIPGTRVGPTLMCLFVTQFQRLRDGDRFWYENPGVFTPAQLTQLKQASLSRVLCDNGDSIQQVQADVFVKAEYPQDYLNCSEIPKVDLRVWQDCCADCRSRGQFRAVTQESQKKRSAQYSYPVDKDMELSHLRSRQQDKIYVGEDARNVTVLAKTKFSQDFSTFAAEIQETITALREQINKLEARLRQAGCTDVRGVPRKAEERWMKEDCTHCICESGQVTCVVEICPPAPCPSPELVKGTCCPVCRDRGMPSDSPEKR

SEQ ID NO: 11182 - protein, 582 aa, Homo Sapiens
NNLQQPTWGAALTAFARLLQPAYRDGIRAPRGLGLPVGSRQPLPPPRLVATVWARAAAVTPDHSYTRMLMHWGWFLEHDLDHTVPALSTARFSDGRPCSSVCTNDPPCFPMNTRHADPRGTHAPCMLFARSSPACASGRPSATVDSVYAREQINQQTAYIDGSNVYGSSERESQALRDPSVPRGLLKTGFPWPPSGKPLLPFSTGPPTECARQEQESPCFLAGDHRANEHLALAAMHTLWFREHNRMATELSALNPHWEGNTVYQEARKIVGAELQHITYSHWLPKVLGDPGTRMLRGYRGYNPNVNAGIINSFATAAFRFGHTLINPILYRLNATLGEISEGHLPFHKALFSPSRIIKEGGIDPVLRGLFGVAAKWRAPSYLLSPELTQRLFSAAYSAAVDSAATIIQRGRDHGIPPYVDFRVFCNLTSVKNFEDLQNEIKDSEIRQKLRKLYGSPGDIDLWPALMVEDLIPGTRVGPTLMCLFVTQFQRLRDGDRFWYENPGVFTPAQLTQLKQASLSRVLCDNGDSIQQVQADVFVKAEYPQDYLNCSEIPKVDLRVWQDCCADKQAGGTPEAGRVYRC

SEQ ID NO: 11183 - protein, 537 aa, Homo Sapiens
  misc_feature (1)..(1): Xaa can be any naturally occurring amino acid
XAREQINQQTAYIDGSNVYGSSERESQALRDPSVPRGLLKTGFPWPPSGKPLLPFSTGPPTECARQEQESPCFLAGDHRANEHLALAAMHTLWFREHNRMATELSALNPHWEGNTVYQEARKIVGAELQHITYSHWLPKVLGDPGTRMLRGYRGYNPNVNAGIINSFATAAFRFGHTLINPILYRLNATLGEISEGHLPFHKALFSPSRIIKEGGIDPVLRGLFGVAAKWRAPSYLLSPELTQRLFSAAYSAAVDSAATIIQRGRDHGIPPYVDFRVFCNLTSVKNFEDLQNEIKDSEIRQKLRKFWYENPGVFTPAQLTQLKQASLSRVLCDNGDSIQQVQADVFVKAEYPQDYLNCSEIPKVDLRVWQDCCADCRSRGQFRAVTQESQKKRSAQYSYPVDKDMELSHLRSRQQDKIYVGEDARNVTVLAKTKFSQDFSTFAAEIQETITALREQINKLEARLRQAGCTDVRGVPRKAEERWMKEDCTHCICESGQVTCVVEICPPAPCPSPELVKGTCCPVCRDRGMPSDSPEKR

SEQ ID NO: 11184 - protein, 463 aa, Homo Sapiens
MDVLTALLLVHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 11185 - protein, 26 aa, Homo Sapiens
MLFRNRFLLLLALAALLAFVSLSLQF

SEQ ID NO: 11186 - protein, 26 aa, Homo Sapiens
MLFRNRFLLLLALAALLAFVSLSLQF

SEQ ID NO: 11187 - protein, 95 aa, Homo Sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFI

SEQ ID NO: 11188 - protein, 145 aa, Homo Sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFE

SEQ ID NO: 11189 - protein, 480 aa, Homo Sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 11190 - protein, 480 aa, Homo Sapiens; identical to SEQ ID NO: 11189

SEQ ID NO: 11191 - protein, 179 aa, Homo Sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTVGLAVHLRGSC

SEQ ID NO: 11192 - protein, 182 aa, Homo Sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTVRRWLSASQEERPH

SEQ ID NO: 11193 - protein, 182 aa, Homo Sapiens; identical to SEQ ID NO: 11192

SEQ ID NO: 11194 - protein, 471 aa, Homo Sapiens
MRYFIKSMEHSVCPSSAVHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 11195 - protein, 131 aa, Homo Sapiens
MSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTG

SEQ ID NO: 11196 - protein, 442 aa, Homo Sapiens
MSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 11197 - protein, 90 aa, Homo Sapiens
MVFVRRPWPALTTVLLALLVCLGALVDAYPIKPEAPREDASPEELNRYYASLRHYLNLVTRQRYGKRDGPDTLLSKTFFPDGEDRPVRSR

SEQ ID NO: 11198 - protein, 97 aa, Homo Sapiens
MVFVRRPWPALTTVLLALLVCLGALVDAYPIKPEAPREDASPEELNRYYASLRHYLNLVTRQRYGKRDGPDTLLSKTFFPDGEDRPVRSRSEGPDLW

SEQ ID NO: 11199 - protein, 144 aa, Homo Sapiens
MRKDRLLHLCLVLLLILLSASDSNSTEPQYMVLVPSLLHTEAPKKGCVLLSHLNETVTVSASLESGRENRSLFTDLVAEKDLFHCVSFTLPRISASSEVAFLSIQIKGPTQDFRKRNTVLVLNTQSLVFVQTDKPMYKPGQTGK

SEQ ID NO: 11200 - protein, 1482 aa, Homo Sapiens
MRKDRLLHLCLVLLLILLSASDSNSTEPQYMVLVPSLLHTEAPKKGCVLLSHLNETVTVSASLESGRENRSLFTDLVAEKDLFHCVSFTLPRISASSEVAFLSIQIKGPTQDFRKRNTVLVLNTQSLVFVQTDKPMYKPGQTVRFRVVSVDENFRPRNELIPLIYLENPRRNRIAQWQSLKLEAGINQLSFPLSSEPIQGSYRVVVQTESGGRIQHPFTVEEFVLPKFEVKVQVPKIISIMDEKVNITVCGEYTYGKPVPGLATVSLCRKLSRVLNCDKQEVCEEFSQQLNSNGCITQQVHTKMLQITNTGFEMKLRVEARIREEGTDLEVTANRISEITNIVSKLKFVKVDSHFRQGIPFFAQVLLVDGKGVPIPNKLFFISVNDANYYSNATTNEQGLAQFSINTTSISVNKLFVRVFTVHPNLCFHYSWVAEDHQGAQHTANRVFSLSGSYIHLEPVAGTLPCGHTETITAHYTLNRQAMGELSELSFHYLIMAKGVIVRSGTHTLPVESGDMKGSFALSFPVESDVAPIARMFIFAILPDGEVVGDSEKFEIENCLANKVDLSFSPAQSPPASHAHLQVAAAPQSLCALRAVDQSVLLMKPEAELSVSSVYNLLTVKDLTNFPDNVDQQEEEQGHCPRPFFIHNGAIYVPLSSNEADIYSFLKGMGLKVFTNSKIRKPKSCSVIPSVSAGAVGQGYYGAGLGVVERPYVPQLGTYNVIPLNNEQSSGPVPETVRSYFPETWIWELVAVNSSGVAEVGVTVPDTITEWKAGAFCLSEDAGLGISSTASLRAFQPFFVELTMPYSVIRGEVFTLKATVLNYLPKCIRVSVQLKASPAFLASQNTKGEESYCICGNERQTLSWTVTPKTLGNVNFSVSAEAMQSLELCGNEVVEVPEIKRKDTVIKTLLVEAEGIEQEKTFSSMTCASGANVSEQLSLKLPSNVVKESARASFSVLGDILGSAMQNIQNLLQMPYGCGEQNMVLFAPNIYVLNYLNETQQLTQEIKAKAVGYLITGYQRQLNYKHQDGSYSTFGERYGRNQGNTWLTAFVLKTFAQARSYIFIDEAHITQSLTWLSQMQKDNGCFRSSGSLLNNAIKGGVEDEATLSAYVTIALLEIPLPVTNPIVRNALFCLESAWNVAKEGTHGSHVYTKALLAYAFSLLGKQNQNREILNSLDKEAVKEDNLVHWERPQRPKAPVGHLYQTQAPSAEVEMTSYVLLAYLTAQPAPTSGDLTSATNIVKWIMKQQNAQGGFSSTQDTVVALHALSRYGAATFTRTEKTAQVTVQDSQTFSTNFQVDNNNLLLLQQISLPELPGEYVITVTGERCVYLQTSMKYNILPEKEDSPFALKVQTVPQTCDGHKAHTSFQISLTISYTGNRPASNMVIVDVKMVSGFIPLKPTVKMLERSSSVSRTEVSNNHVLIYVEQVTNQTLSFSFMVLQDIPVGDLKPAIVKVYDYYETDESVVAEYIAPCSTDTEHGNV

SEQ ID NO: 11201 - protein, 284 aa, Homo Sapiens
MAGGRHRRVVGTLHLLLLVAALPWASRGVSPSASAWPEEKHIMQRIQRLQADWVLEIDTFLSQTPYGYRSFSNIISTLNPTAKRHLVLACHYDSKYFSHWNNRVFVGATDSAVPCAMMLELARALDKKLLSLKTVSDSKPDLSLQLIFFDGEEAFLHWSPQDSLYGSRHLAAKMASTPHPPGARGTSQLHGMDLLVLLDLIGAPNPTFPNFFPNSARWFERLQAIEHELHELGLLKDHSLEGRYFQNYSYGGVIQDDHIPFLRRGVPVLHLIPSPFPEVWHTMD

SEQ ID NO: 11202 - protein, 361 aa, Homo Sapiens
MAGGRHRRVVGTLHLLLLVAALPWASRGVSPSASAWPEEKNYHQPAILNSSALRQIAEGTSISEMWQNDLQPLLIERYPGSPGSYAARQHIMQRIQRLQADWVLEIDTFLSQTPYGYRSFSNIISTLNPTAKRHLVLACHYDSKYFSHWNNRVFVGATDSAVPCAMMLELARALDKKLLSLKTVSDSKPDLSLQLIFFDGEEAFLHWSPQDSLYGSRHLAAKMASTPHPPGARGTSQLHGMDLLVLLDLIGAPNPTFPNFFPNSARWFERLQAIEHELHELGLLKDHSLEGRYFQNYSYGGVIQDDHIPFLRRGVPVLHLIPSPFPEVWHTMDDNEENLDESTIDNLNKILQVFVLEYLHL

SEQ ID NO: 11203 - protein, 118 aa, Homo Sapiens [sequence omitted]

SEQ ID NO: 11204 - protein, 149 aa, Homo Sapiens
MDAEGLALLLPPVTLAALVDSWLREDCPGLNYAALAVRAARQAADFTLKVEVECSSLQEAVQAAEAGADLVLLDNFKPEELHPTATVLKAQFPSVAVEASGGITLDNLPQFCGPHIDVISMGMLTQAAPALDFSLKLFAKEVAPVPKIH

SEQ ID NO: 11205 - protein, 297 aa, Homo Sapiens
MDAEGLALLLPPVTLAALVDSWLREDCPGLNYAALVSGAGPSQAALWAKSPGVLAGQPFFDAIFTQLNCQVSWFLPEGSKLVPVARVAEVRGPAHCLLLGERVALNTLARCSGIASAAAAAVEAARGAGWTGHVAGTRKTTPGFRLVEKYGLLVGGAASHRYDLGGLVMVKDNHVVAAGGVEKAVRAARQAADFTLKVEVECSSLQEAVQAAEAGADLVLLDNFKPEELHPTATVLKAQFPSVAVEASGGITLDNLPQFCGPHIDVISMGMLTQAAPALDFSLKLFAKEVAPVPKIH

SEQ ID NO: 11206 - protein, 136 aa, Homo Sapiens
MVRPYPLIYFLFLPLGACFPLLDRREPTDAMGGLGAGERWADLAMGPRPHSVWGSSRWLRASQPQALLVIARGLQTSGREHAGCRFRFGRQDEGSEATGFLPAAGEKTSGPLGNLAEELNGYSRKKGGFSFRFGRR

SEQ ID NO: 11207 - protein, 136 aa, Homo Sapiens; identical to SEQ ID NO: 11206

SEQ ID NO: 11208 - protein, 155 aa, Homo Sapiens
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPGWRRLMDSLREITKSTWL

SEQ ID NO: 11209 - protein, 747 aa, Homo Sapiens
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPEASRPPKLHPGLRAAPGQEPPEHMAELQRNEQEQPLGQWHLSKRDTGAALLAESRAEKNRLWGPLEVRRVGRSSKQLVDIPEGQLEARAGRGRGQWLQVLGGGFSYLDISLCVGLYSLSFMGLLAMYTYFQAKIRALKGHAGHPAA

SEQ ID NO: 11210 - protein, 604 aa, Homo Sapiens
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPELI

SEQ ID NO: 11211 - protein, 72 aa, Homo Sapiens
  misc_feature (1)..(1): Xaa can be any naturally occurring amino acid
XNEQEQPLGQWHLSKRDTGAALLAESRAEKNRLWGPLEVRRVGRSSKQLVDIPEGQLEARAGRGRGQWLQLI

SEQ ID NO: 11212 - protein, 253 aa, Homo Sapiens
MPLLPSTVGLAGLLFWAGQAVNALIMPNATPAPAQPESTAMRLLSGLEVPRYRRKRHISVRDMNALLDYHNHIRASVYPPAANMEYMVWDKRLARAAEAWATQCIWAHGPSQLMRYVGQNLSIHSGQYRSVVDLMKSWSEEKWHYLFPAPRDCNPHCPWRCDGPTCSHYTQMVWASSNRLGCAIHTCSSISVWGNTWHRAAYLVCNYAIKGNWIGESPYKMGKPCSSCPPSYQGSCNSNMCFKGLKSNKFTWF

SEQ ID NO: 11213 - protein, 190 aa, Homo Sapiens
MLVGDSGVGKTCLLVRFKDGAFLAGTFISTVGIDFRNKVLDVDGVKVKLQMWDTAGQERFRSVTHAYYRDAHALLLLYDVTNKASFDNIQAWLTEIHEYAQHDVALMLLGNKVDSAHERVVKREDGEKLAKEYGLPFMETSAKTGLNVDLAFTAIAKELKQRSMKAPSEPRFRLHDYVKREGRGASCCRP

SEQ ID NO: 11214 - protein, 64 aa, Homo Sapiens
MLVGDSGVGKTCLLVRFKDGAFLAGTFISTVGIDFRQGLTLSPWLECSGDHGGLQPPTSGFKPS

SEQ ID NO: 11215 - protein, 256 aa, Homo Sapiens
MSRKKTPKSKGASTPAASTLPTANGARPARSGTALSGPDAPPNGPLQPGRPSLGGGVDFYDVAFKVMLVGDSGVGKTCLLVRFKDGAFLAGTFISTVGIDFRNKVLDVDGVKVKLQMWDTAGQERFRSVTHAYYRDAHALLLLYDVTNKASFDNIQAWLTEIHEYAQHDVALMLLGNKVDSAHERVVKREDGEKLAKEYGLPFMETSAKTGLNVDLAFTAIAKELKQRSMKAPSEPRFRLHDYVKREGRGASCCRP

SEQ ID NO: 11216 - protein, 136 aa, Homo Sapiens
  misc_feature (1)..(1): Xaa can be any naturally occurring amino acid
XKEYGLPFMETSAKTGLNVDLAFTAIANNSPNKQASESPWPHTGRHGKAVFCTGRGAASGQTLPRCSAAPSWARPGEGGLGLAPRTVPNPRKAMSSAAHAQAAKGGRLPTPGTEGFTANHIVHLCVLGAACSRPTL

SEQ ID NO: 11217 - protein, 311 aa, Homo Sapiens
MVIAGASWMLGRAAASPTQTPPTTSTIRVARRSRVALVAMVIAAAGSGGPGRAEPQLSQPSLDCGRMRSSLTPLGPPVSRDRVIASFPKWYTPEACLQLREHFHGQVSAACQRRNTGTVGFCKNVFDRDYKATIGVDFEIERFEIAGIPYSLQIWDTAGQEKFKCIASAYYRGAQVIITAFDLTDVQTLEHTRQWLEDALRENEAGSCFIFLVGTKKDLLSGAACEQAEADAVHLAREMQAEYWSVSAKTGENVKAFFSRVAALAFEQSVLQDLERQSSARLQVGNGDLIQMEGSPPETQESKRPSSLGCC

SEQ ID NO: 11218 - protein, 333 aa, Homo Sapiens
MVIAGASWMLGRAAASPTQTPPTTSTIRVARRSRVALVAMVIAAAGSGGPGRAEPQLSQPSLDCGRMRSSLTPLGPPVSRDRVIASFPKWYTPEACLQLREHFHGQVSAACQRRNTGTVGLKLSKVVVVGDLYVGKTSLIHRFCKNVFDRDYKATIGVDFEIERFEIAGIPYSLQIWDTAGQEKFKCIASAYYRGAQVIITAFDLTDVQTLEHTRQWLEDALRENEAGSCFIFLVGTKKDLLSGAACEQAEADAVHLAREMQAEYWSVSAKTGENVKAFFSRVAALAFEQSVLQDLERQSSARLQVGNGDLIQMEGSPPETQESKRPSSLGCC

SEQ ID NO: 11219 - protein, 132 aa, Homo Sapiens
  misc_feature (1)..(1): Xaa can be any naturally occurring amino acid
XVSAACQRRNTGTVGLKLSKVVVVGDLYVGKTSLIHRFCKNVFDRDYKATIGVDFEIERFEIAGIPYSLQIWDTAGQEKFKCIASAYYRGAQGEQHATSGLNCMQQRGPCRAPQWESRVLCTGTSFLSSKTH

SEQ ID NO: 11220 - protein, 201 aa, Homo Sapiens
MSGKSLLLKVILLGDGGVGKSSLMNRYVTNKFDSQAFHTIGVEFLNRDLEVDGRFVTLQIWDTAGQERFKSLRTPFYRGADCCLLTFSVDDRQSFENLGNWQKEFIYYADVKDPEHFPFVVLGNKVDKEDRQVTTEEAQTWCMENGDYPYLETSAKDDTNVTVAFEEAVRQVLAVEEQLEHCMLGHTIDLNSGSKAGSSCC

SEQ ID NO: 11221 - protein, 80 aa, Homo Sapiens
MRRISLTSSPVRLLLFLLLLLIALEIMVGGHSLCFNFTIKSLSRPGQPWCEAQVFLNKNLFLQYNSDNNMVKPLGLLGKK

SEQ ID NO: 11222 - protein, 117 aa, Homo Sapiens
MRRISLTSSPVRLLLFLLLLLIALEIMVGGHSLCFNFTIKSLSRPGQPWCEAQVFLNKNLFLQYNSDNNMVKPLGLLGKKILPLCKSRCFVNVKQNGALVHPGSSPPMERNPSSLTQ

SEQ ID NO: 11223 - protein, 209 aa, Homo Sapiens
MRRISLTSSPVRLLLFLLLLLIALEIMVGGHSLCFNFTIKSLSRPGQPWCEAQVFLNKNLFLQYNSDNNMVKPLGLLGKKVYATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTGN

SEQ ID NO: 11224 - protein, 212 aa, Homo Sapiens
MRRISLTSSPVRLLLFLLLLLIALEIMVGGHSLCFNFTIKSLSRPGQPWCEAQVFLNKNLFLQYNSDNNMVKPLGLLGKKVYATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTGRRST

SEQ ID NO: 11225 - protein, 263 aa, Homo Sapiens
MRRISLTSSPVRLLLFLLLLLIALEIMVGGHSLCFNFTIKSLSRPGQPWCEAQVFLNKNLFLQYNSDNNMVKPLGLLGKKVYATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTVSPVNASDIHWSSSSLPDRWIILGAFILLVLMGIVLICVWWQNGEWQAGLWPLRTS

SEQ ID NO: 11226 - protein, 227 aa, Homo Sapiens
MRRISLTSSPVRLLLFLLLLLIALEIMYNSDNNMVKPLGLLGKKVYATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTVSPVNASDIHWSSSSLPDRWIILGAFILLVLMGIVLICVWWQNGEWQAGLWPLRTS

SEQ ID NO: 11227 - protein, 334 aa, Homo Sapiens
MAAAASPAFLLRLPLLLLLSSWCRTGLADPHSLCYDITVIPKFRPGPRWCAVQGQVDEKTFLHYDCGSKTVTPVSPLGKKLNVTTAWKAQNPVLREVVDILTEQLLDIQLENYIPKEPLTLQARMSCEQKAEGHGSGSWQLSFDGQIFLLFDSENRMWTTVHPGARKMKEKWENDKDMTMSFHYISMGDCTGWLEDFLMGMDSTLEPSAGAPPTMSSGTAQPRATATTLILCCLLIMCLLICSRHSLTQSHGHHPQSLQPPPHPPLLHPTWLLRRVLWSDSYQIAKRPLSGGHVTRVTLPIIGDDSHSLPCPLALYTINNGAARYSEPLQVSIS

SEQ ID NO: 11228 - protein, 221 aa, Homo Sapiens
MAAAASPAFLLRLPLLLLLSSWCRTGLADPHSLCYDITVIPKFRPGPRWCAVQGQVDEKTFLHYDCGSKTVTPVSPLGKKLNVTTAWKAQNPVLREVVDILTEQLLDIQLENYIPKEPLTLQARMSCEQKAEGHGSGSWQLSFDGQIFLLFDSENRMWTTVHPGARKMKEKWENDKDMTMSFHYISMGDCTGWLEDFLMGMDSTLEPSAGGNRRKRNGDLQ

SEQ ID NO: 11229 - protein, 213 aa, Homo Sapiens
MAAAASPAFLLRLPLLLLLSSWCRTGLADPHSLCYDITVIPKFRPGPRWCAVQGQVDEKTFLHYDCGSKTVTPVSPLGKKLNVTTAWKAQNPVLREVVDILTEQLLDIQLENYIPKEPLTLQARMSCEQKAEGHGSGSWQLSFDGQIFLLFDSENRMWTTVHPGARKMKEKWENDKDMTMSFHYISMGDCTGWLEDFLMGMDSTLEPSAGGTV

SEQ ID NO: 11230 - protein, 180 aa, Homo Sapiens
MASLRVERAGGPRLPRTRVGRPAALRLLLLLGAVLNPHEALAQPLPTTGTPGSEASVPTGGTVKNYETAVQFCWNHYKDQMDPIEKDWCDWAMISRPYSTLRDCLEHFAELFDLGFPNPLAERIIFETHQIHFANCSLVQPTFSDPPEDVLLAMIIAPICLIPFLITLVVWRSKDSEAQA

SEQ ID NO: 11231 - protein, 175 aa, Homo Sapiens
MASLRVERAGGPRLPRTRVGRPAALRLLLLLGAVLNPHEALAQPLPTTGTPGSEGGTVKNYETAVQFCWNHYKDQMDPIEKDWCDWAMISRPYSTLRDCLEHFAELFDLGFPNPLAERIIFETHQIHFANCSLVQPTFSDPPEDVLLAMIIAPICLIPFLITLVVWRSKDSEAQA

SEQ ID NO: 11232 - protein, 112 aa, Homo Sapiens
MASLRVERAGGPRLPRTRVGRPAALRLLLLLGAVLNPHEALAQPLPTTGTPGSEGLIAPCEIAWSTLQSCLTWASPIPWQRGSSLRLTRSTLPTAPWCSPPSLTPQRMYSWP

SEQ ID NO: 11233 - protein, 49 aa, Homo Sapiens
MDPIEKDWCDWAMISRPYSTLRDCLEHFAELFDLGFPNPLAERIIFETH

SEQ ID NO: 11234 - protein, 100 aa, Homo Sapiens
MDPIEKDWCDWAMISRPYSTLRDCLEHFAELFDLGFPNPLAERIIFETHQIHFANCSLVQPTFSDPPEDVLLAMIIAPICLIPFLITLVVWRSKDSEAQA

SEQ ID NO: 11235 - protein, 730 aa, Homo Sapiens
MAIGVWQLLLDMGIMLSVDQHLYFQDTYVFYQFSSDECSYLYCEFEREEEWQNGVKLLLQLVPLIPARGGICELSHQKIEDSEESSDEILVRLTSAVQRELAAVIALKARKSAIEQDEENNDKHVAVTEAESVPDSQAGVMCKLQERDEIGRIELVQKLAKENYQFLQTDKKEQEKSEHQDDEVTTVQVKEQDQSVLVLKKVQCCGPAPTAGSAESHWRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGEKHELQPNDLVISKSLEASGRIYVYRKDLADTLNPFAENEESQQRSMRILGMNTWDLALELMNFDWSLFNSIHEQELIYFTFSRQGSGEHTANLSLLLQRCNEVQLWVATEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 11236 - protein, 580 aa, Homo Sapiens
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGEKHELQPNDLVISKSLEASGRIYVYRKDLADTLNPFAENEESQQRSMRILGMNTWDLALELMNFDWSLFNSIHEQELIYFTFSRQGSGEHTANLSLLLQRCNEVQLWVATEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 11237 - protein, 444 aa, Homo Sapiens
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 11238 - protein, 124 aa, Homo Sapiens
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETVIPTPGITCVTSAMCSQSQADQDFMA

SEQ ID NO: 11239 - protein, 400 aa, Homo Sapiens
MRMAVGSVKMQPPCESPALAAAAAVVAADGPLRRSPSAREPEREQPPASLRPRLRDLPALLRSGLTLRRKRSAAGGRTLSRRISNPYLEHTPSQIYGENSSCAGRALRNIIIVQAADLIKDRVNLKGFYRRSCVGSELVDWLLEHCPFVQCRSMAIGVWQLLLDMGIMLSVDQHLYFQDTYVFYQFSSDECSYLYCEFEREEEWQNGVKLLLQLVPLIPARGGICELSHQKIEDSEESSDEILVRLTSAVQRELAAVIALKARKSAIEQDEENNDKHVAVTEAESVPDSQAGVMCKLQERDEIGRIELVQKLAKENYQFLQTDKKEQEKSEHQDDEVTTVQVKEQDQSVLVLKKVQCCGPAPTAGSAESHWSVLADCRALSSQMDSVPSERTGMARSFSI

SEQ ID NO: 11240 - protein, 155 aa, Homo Sapiens
MSWDCGFKYIFAFSPTLKAGVMCKLQERDEIGRIELVQKLAKENYQFLQTDKKEQEKSEHQDDEVTTVQVKEQDQSVLVLKKVQCCGPAPTAGSAESHWRYVVVSGTPEKILEHLLNDLHLEEVQDKETETLLDDFLLTYTVFMTTDDLCQALLR

SEQ ID NO: 11241 - protein, 142 aa, Homo Sapiens
MTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSY

SEQ ID NO: 11242 - protein, 294 aa, Homo Sapiens
MQPRRQRLPAPWSGPRGPRPTAPLLALLLLLAPVAAPAGSGDPDDPGQPQDAGVPRRLLQQAARAALHFFNFRSGSPSALRVLAEVQEGRAWINPKEGCKVHVVFSTERYNPESLLQEGEGRLGKCSARVFFKNQKPRPTINVTCTRLIEKKKRQQEDYLLYKQMKQLKNPLEIVSIPDNHGHIDPSLRLIWDLAFLGSSYVMWEMTTQVSHYYLAQLTSVRQWKTNDDTIDFDYTVLLHELSTQEIIPCRIHLVWYPGKPLKVKYHCQELQTPEEASGTEEGSAVVPTELSNF

SEQ ID NO: 11243 - protein, 228 aa, Homo Sapiens
MQPRRQRLPAPWSGPRGPRPTAPLLALLLLLAPVAAPAGSGDPDDPGQPQDAGVPRRLLQQAARAALHFFNFRSGSPSALRVLAEVQEGRAWINPKEGCKVHVVFSTERYNPESLLQEGEGRLGKCSARVFFKNQKPRPTINVTCTRLIEKKKRQQEDYLLYKQMKQLKNPLEIVSIPDNHGHIDPSLRLIWDLAFLGSSYVMWEMTTQVSHYYLAQLTSVRQWVRKT

SEQ ID NO: 11244 - protein, 163 aa, Homo Sapiens
MRRLLIPLALWLGAVGVGVAELTEAQRRGLQVALEEFHKHPPVQWAFQETSVESAVDTPFPAGIFVRLEFKLQQTSCRKRDWKKPECKVRPNGRKRKCLACIKLGSEDKVLGRLVHCPIETQVLREAEEHQETQCLRVQRAGEDPHSFYFPGQFAFSKALPRS

SEQ ID NO: 11245 - protein, 163 aa, Homo Sapiens; identical to SEQ ID NO: 11244

SEQ ID NO: 11246 - protein, 163 aa, Homo Sapiens; identical to SEQ ID NO: 11244

SEQ ID NO: 11247 - protein, 159 aa, Homo Sapiens
MRRLLIPLALWLGAVGVGVAELTEAQRRGLQVALEEFHKHPPVQWAFQETSVESAVDTPFPAGIFVRLEFKLQQTSCRKRDWKKPECKVRPNGRKRKCLACIKLGSEDKVLGRLVHCPIETQVLRRCVVPPGPLRVVTSGRPQPPGRGTRSIPSHDNKA

SEQ ID NO: 11248 - protein, 47 aa, Homo Sapiens
MAAAAPAAAAASSEAPAASATAEPEAGDQDSREVKQKIYCHILDPTK

SEQ ID NO: 11249 - protein, 849 aa, Homo Sapiens
MAAAAPAAAAASSEAPAASATAEPEAGDQDSREVRVLQSLRGKICEAKNLLPYLGPHKMRDCFCTINLDQEEVYRTQVVEKSLSPFFSEEFYFEIPRTFQYLSFYVYDKNVLQRDLRIGKVAIKKEDLCNHSGKETWFSLQPVDSNSEVQGKVHLELKLNELITENGTVCQQLVVHIKACHGLPLINGQSCDPYATVSLVGPSRNDQKKTKVKKKTSNPQFNEIFYFEVTRSSSYTRKSQFQVEEEDIEKLEIRIDLWNNGNLVQDVFLGEIKVPVNVLRTDSSHQAWYLLQPRDNGNKSSKTDDLGSLRLNICYTEDYVLPSEYYGPLKTLLLKSPDVQPISASAAYILSEICRDKNDAVLPLVRLLLHHDKLVPFATAVAELDLKDTQDANTIFRGNSLATRCLDEMMKIVGGHYLKVTLKPILDEICDSSKSCEIDPIKLKEGDNVENNKENLRYYVDKLFNTIVKSSMSCPTVMCDIFYSLRQMATQRFPNDPHVQYSAVSSFVFLRFFAVAVVSPHTFHLRPHHPDAQTIRTLTLISKTIQTLGSWGSLSKSKSSFKETFMCEFFKMFQEEGYIIAVKKFLDEISSTETKESSGTSEPVHLKEGEMYKRAQGRTRIGKKNFKKRWFCLTSRELTYHKQPGKDAIYTIPVKNILAVEKLEESSFNKKNMFQVIHTEKPLYVQANNCVEANEWIDVLCRVSRCNQNRLSFYHPSVYLNGNWLCCQETGENTLGCKPCTAGVPADIQIDIDEDRETERIYSLFTLSLLKLQKMEEACGTIAVYQGPQKEPDDYSNFVIEDSVTTFKTIQQIKSIIEKLDEPHEKYRKKRSSSAKYGSKENPIVGKAS

SEQ ID NO: 11250 - protein, 853 aa, Homo Sapiens [sequence omitted]

SEQ ID NO: 11251 - protein, 155 aa, Homo Sapiens
MAPRTWCPAGIFGLFCPLTLACSSLTIALTDCQPIILVSPTLSLWMVVRSVWIMQASLLGEPEEVALGPMGVVAATLEVVGTRAMGVAGIMTVDLEGMDMDMDVPETIMAETRVVMTATQEEITETIMTTEMRHAHNIGETWISALSEPVCHTLS

SEQ ID NO: 11252 - protein, 157 aa, Homo Sapiens
MSSEEGKLFVGGLNFNTDEQALEDHFSSFGPISEVVVVKDRETQRSRGFGFITFTNPEHASVAMRAMNGESLDGRQIRVDHAGKSARGTRGGGFGAHGRGRSYSRGGGDQGYGSGRYYDSRPGGYGYGYGRSRDYNGRNQGGYDRYSGGNYRDNYDN

SEQ ID NO: 11253 - protein, 157 aa, Homo Sapiens; identical to SEQ ID NO: 11252

SEQ ID NO: 11254 - protein, 1247 aa, Homo Sapiens
MMREWVLLMSVLLCGLAGPTHLFQPSLVLDMAKVLLDNYCFPENLLGMQEAIQQAIKSHEILSISDPQTLASVLTAGVQSSLNDPRLVISYEPSTPEPPPQVPALTSLSEEELLAWLQRGLRHEVLEGNVGYLRVDSVPGQEVLSMMGEFLVAHVWGNLMGTSALVLDLRHCTGGQVSGIPYIISYLHPGNTILHVDTIYNRPSNTTTEIWTLPQVLGERYGADKDVVVLTSSQTRGVAEDIAHILKQMRRAIVVGERTGGGALDLRKLRIGESDFFFTVPVSRSLGPLGGGSQTWEGSGVLPCVGTPAEQALEKALAILTLRSALPGVVHCLQEVLKDYYTLVDRVPTLLQHLASMDFSTVVSEEDLVTKLNAGLQAASEDPRLLVRAIGPTETPSWPAPDAAAEDSPGVAPELPEDEAIRQALVDSVFQVSVLPGNVGYLRFDSFADASVLGVLAPYVLRQVWEPLQDTEHLIMDLRHNPGGPSSAVPLLLSYFQGPEAGPVHLFTTYDRRTNITQEHFSHMELPGPRYSTQRGVYLLTSHRTATAAEEFAFLMQSLGWATLVGEITAGNLLHTRTVPLLDTPEGSLALTVPVLTFIDNHGEAWLGGGVVPDAIVLAEEALDKAQEVLEFHQSLGALVEGTGHLLEAHYARPEVVGQTSALLRAKLAQGAYRTAVDLESLASQLTADLQEVSGDHRLLVFHSPGELVVEEAPPPPPAVPSPEELTYLIEALFKTEVLPGQLGYLRFDAMAELETVKAVGPQLVRLVWQQLVDTAALVIDLRYNPGSYSTAIPLLCSYFFEAEPRQHLYSVFDRATSKVTEVWTLPQVAGQRYGSHKDLYILMSHTSGSAAEAFAHTMQDLQRATVIGEPTAGGALSVGIYQVGSSPLYASMPTQMAMSATTGKAWDLAGVEPDITVPMSEALSIAQDIVALRAKVPTVLQTAGKLVADNYASAELGAKMATKLSGLQSRYSRVTSEVALAEILGADLQMLSGDPHLKAAHIPENAKDRIPGIVPMQIPSPEVFEELIKFSFHTNVLEDNIGYLRFDMFGDGELLTQVSRLLVEHIWKKIMHTDAMIIDMRFNIGGPTSSIPILCSYFFDEGPPVLLDKIYSRPDDSVSELWTHAQVVGERYGSKKSMVILTSSVTAGTAEEFTYIMKRLGRALVIGEVTSGGCQPPQTYHVDDTNLYLTIPTARSVGASDGSSWEGVGVTPHVVVPAEEALARAKEMLQHNQLRVKRSPGLQDHL

SEQ ID NO: 11255 - protein, 201 aa, Homo Sapiens
MKWVWALLLLAALGSGRAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCADSYSFVFSRDPNGLPPEAQKIVRQRQEELCLARQYRLIVHNGYCDGRSERNLL

SEQ ID NO: 11256 - protein, 201 aa, Homo Sapiens; identical to SEQ ID NO: 11255

SEQ ID NO: 11257 - protein, 199 aa, Homo Sapiens
MNYSKIPAQVDLRRQTERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCADSYSFVFSRDPNGLPPEAQKIVRQRQEELCLARQYRLIVHNGYCDGRSERNLL

SEQ ID NO: 11258 - protein, 199 aa, Homo Sapiens; identical to SEQ ID NO: 11257

SEQ ID NO: 11259 - protein, 28 aa, Homo Sapiens
EILENWNMFVGSQATNYGEDLTKNHDEL

SEQ ID NO: 11260 - protein, 331 aa, Homo Sapiens
MARGGRGRRLGLALGLLLALVLAPRVLRAKPTVRKERVVRPDSELGERPPEDNQSFQYDHEAFLGKEDSKTFDQLTPDESKERLGKIVDRIDNDGDGFVTTEELKTWIKRVQKRYIFDNVAKVWKDYDRDKDDKISWEEYKQATYGYYLGNPAEFHDSSDHHTFKKMLPRDERRFKAADLNGDLTATREEFTAFLHPEEFEHMKEIVVLETLEDIDKNGDGFVDQDEYIADMFSHEENGPEPDWVLSEREQFNEFRDLNKDGKLDKDEIRHWILPQDYDHAQAEARHLVYESDKNKDEKLTKEEILENWNMFVGSQATNYGEDLTKNHDEL

SEQ ID NO: 11261 - protein, 20 aa, Homo Sapiens
MLPRDERRFKAADLNGDLTA

SEQ ID NO: 11262 - protein, 57 aa, Homo Sapiens
  misc_feature (1)..(1): Xaa can be any naturally occurring amino acid
XETLEDIDKNGDGFVDQDEYIDKETSGSVTELSQKPGFIFWLLNSVLSTPPHGLHHE

SEQ ID NO: 11263 - protein, 335 aa, Homo Sapiens
MRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKEFAICKKQSFCFWLLRFNLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKKLSEEEILENPDLFLTSEATDYGRQLHDDYFYHDEL

SEQ ID NO: 11264 - protein, 317 aa, Homo Sapiens
MRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKKLSEEEILENPDLFLTSEATDYGRQLHDDYFYHDEL

SEQ ID NO: 11265 - protein, 216 aa, Homo Sapiens
MRLGPRTAALGLLLLCAAAAGAGKAEELHYPLGERRSDYDREALLGVQLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKKLSEEEILENPDLFLTSEATDYGRQLHDDYFYHDEL

SEQ ID NO: 11266 - protein, 155 aa, Homo Sapiens
  misc_feature (1)..(1): Xaa can be any naturally occurring amino acid
XGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKHQCGGLGLHPQSQSA

SEQ ID NO: 11267 - protein, 169 aa, Homo Sapiens
FQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMATREELTAFLHPEEFPHMRDIVIALFFSRIYLLTFLLL

SEQ ID NO: 11268 - protein, 150 aa, Homo Sapiens
MMWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVKNFMTWRMQRPTKRCWLGTSGVSGWPTRMGTR

SEQ ID NO: 11269 - protein, 328 aa, Homo Sapiens
MMWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMATREELTAFLHPEEFPHMRDIVIAETLEDLDRNKDGYVQVEEYIADLYSAEPGEEEPAWVQTERQQFRDFRDLNKDGHLDGSEVGHWVLPPAQDQPLVEANHLLHESDTDKDGRLSKAEILGNWNMFVGSQATNYGEDLTRHHDEL

SEQ ID NO: 11270 - protein, 58 aa, Homo Sapiens
  misc_feature (1)..(1): Xaa can be any naturally occurring amino acid
XTERQQFRDFRDLNKDGHLDGSEDGRLSKAEILGNWNMFVGSQATNYGEDLTRHHDEL

SEQ ID NO: 11271 - protein, 485 aa, Homo Sapiens
MPAMVEKGPEVSGKRRGRNNAAASASAAAASAAASAACASPAATAASGAAASSASAAAASAAAAPNNGQNKSLAAAAPNGNSSSNSWEEGSSGSSSDEEHGGGGMRVGPQYQAVVPDFDPAKLARRSQERDNLGMLVWSPNQNLSEAKLDEYIAIAKEKHGYNMEQALGMLFWHKHNIEKSLADLPNFTPFPDEWTVEDKVLFEQAFSFHGKTFHRIQQMLPDKSIASLVKFYYSWKKTRTKTSVMDRHARKQKREREESEDELEEANGNNPIDIEVDQNKESKKEVPPTETVPQVKKEKHSTQAKNRAKRKPPKGMFLSQEDVEAVSANATAATTVLRQLDMELVSVKRQIQNIKQTNSALKEKLDGGIEPYRLPEVIQKCNARWTTEEQLLAVQAIRKYGRDFQAISDVIGNKSVVQVKNFFVNYRRRFNIDEVLQEWEAEHGKEETNGPSNQKPVKSPDNSIKMPEEEDEAPVLDVRYASAS

SEQ ID NO: 11272 - protein, 35 aa, Homo Sapiens
QTNSALKEKLDGGIEPYRLPEPSGNMAEIFRQSQT

SEQ ID NO: 11273 - protein, 305 aa, Homo Sapiens
MVELMFPLLLLLLPFLLYMAAPQIRKMLSSGVCTSTVQLPGKVVVVTGANTGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 11274 - protein, 187 aa, Homo Sapiens [sequence omitted]

SEQ ID NO: 11275 - protein, 318 aa, Homo Sapiens
MVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 11276 - protein, 248 aa, Homo Sapiens
MVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAEEKHLHVLINNAGVMMCPYSKTADGFEMHIGVNHLGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 11277 - protein, 178 aa, Homo Sapiens
MVELMFPLLLLLLPFLLYMAAPQIRKMLSSGVCTSTVQLPGKVVVVTGANTGIGKETAKELAQRGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQ

SEQ ID NO: 11278 - protein, 61 aa, Homo Sapiens
MVELMFPLLLLLLPFLLYMAAPQIRSLPPNPSAARETKGISPIKDSKCVFPRTSPGKDPLP

SEQ ID NO: 11279 - protein, 62 aa, Homo Sapiens
MVELMFPLLLLLLPFLLYMAAPQIRSSSIFSLPGCGKGGIGGQRDPDHDREPAGVGAETGPV

SEQ ID NO: 11280 - protein, 204 aa, Homo Sapiens
SDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKVQSELVRHSSFMRWMWWLFSFFIKTPQQGAQTSLHCALTEGLEILSGNHFSDCHVAWVSAQARNETIARRLWDVSCDLLGLPID

SEQ ID NO: 11281 - protein, 316 aa, Homo Sapiens
MLVTLGLLTSFFSFLYMVAPSIRKFFAGGVCRTNVQLPGKVVVITGANTGIGKETARELASRGARVYIACRDVLKGESAASEIRVDTKNSQVLVRKLDLSDTKSIRAFAEGFLAEEKQLHILINNAGVMMCPYSKTADGFETHLGVNHLGHFLLTYLLLERLKVSAPARVVNVSSVAHHIGKIPFHDLQSEKRYSRGFAYCHSKLANVLFTRELAKRLQGTGVTTYAVHPGVVRSELVRHSSLLCLLWRLFSPFVKTAREGAQTSLHCALAEGLEPLSGKYFSDCKRTWVSPRARNNKTAERLWNVSCELLGIRWE

SEQ ID NO: 11282 - protein, 316 aa, Homo Sapiens; identical to SEQ ID NO: 11281

SEQ ID NO: 11283 - protein, 42 aa, Homo Sapiens
MEKCEAAAKDIRGETLNHHVNARHLDLASLKSIREFAAKIIE

SEQ ID NO: 11284 - protein, 260 aa, Homo Sapiens
MEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 11285 - protein, 260 aa, Homo Sapiens; identical to SEQ ID NO: 11284

SEQ ID NO: 11286 - protein, 29 aa, Homo Sapiens
MSRYLLPLSALGTVAGAAVLLKDYVTGGA

SEQ ID NO: 11287 - protein, 220 aa, Homo Sapiens
MSRYLLPLSALGTVAGAAVLLKDYVTGGACPSKATIPGKTVIVTGANTGIGKQTALELARRGGNIILACRDMEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQG

SEQ ID NO: 11288 - protein, 220 aa, Homo Sapiens; identical to SEQ ID NO: 11287

SEQ ID NO: 11289 - protein, 331 aa, Homo Sapiens
MSRYLLPLSALGTVAGAAVLLKDYVTGGACPSKATIPGKTVIVTGANTGIGKQTALELARRGGNIILACRDMEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 11290 - protein, 35 aa, Homo Sapiens
MSRYLLPLSALGTVAGAAVLLKRQHHPGLPRHGEV

SEQ ID NO: 11291 - protein, 35 aa, Homo Sapiens; identical to SEQ ID NO: 11290

SEQ ID NO: 11292 - protein, 55 aa, Homo Sapiens
MHVKEAGLFGLVNNAGVAGIIGPTPWLTRDDFQRVLNVNTMGPIGVTLALLPLLQ

SEQ ID NO: 11293 - protein, 221 aa, Homo Sapiens
MHVKEAGLFGLVNNAGVAGIIGPTPWLTRDDFQRVLNVNTMGPIGVTLALLPLLQQARGRVINITSVLGRLAANGGGYCVSKFGLEAFSDSLRRDVAHFGIRVSIVEPGFFRTPVTNLESLEKTLQACWARLPPATQAHYGGAFLTKYLKMQQRIMNLICDPDLTKVSRCLEHALTARHPRTRYSPGWDAKLLWLPASYLPASLVDAVLTWVLPKPAQAVY

SEQ ID NO: 11294 - protein, 318 aa, Homo Sapiens
MWLPLLLGALLWAVLWLLRDRQSLPASNAFVFITGCDSGFGRLLALQLDQRGFRVLASCLTPSGAEDLQRVASSRLHTTLLDITDPQSVQQAAKWVEMHVKEAGLFGLVNNAGVAGIIGPTPWLTRDDFQRVLNVNTMGPIGVTLALLPLLQQARGRVINITSVLGRLAANGGGYCVSKFGLEAFSDSLRRDVAHFGIRVSIVEPGFFRTPVTNLESLEKTLQACWARLPPATQAHYGGAFLTKYLKMQQRIMNLICDPDLTKVSRCLEHALTARHPRTRYSPGWDAKLLWLPASYLPASLVDAVLTWVLPKPAQAVY

SEQ ID NO: 11295 - protein, 318 aa, Homo Sapiens; identical to SEQ ID NO: 11294

SEQ ID NO: 11296 - protein, 103 aa, Homo Sapiens
  misc_feature (1)..(1): Xaa can be any naturally occurring amino acid
XLLLGALLWAVLWLLRDRQSLPASNAFVFITGCDSGFGRLLALQLDQRGFRVLASCLTPSGAEDLQRVASSRLHTTLLDITDPQSVQQAAKWVEMHVKEAGGM

SEQ ID NO: 11297 - protein, 331 aa, Homo Sapiens
MNGQSQVLPGGGHESREGINMAAAPRTVLISGCSSGIGLELAVQLAHDPKKRYQVVATMRDLGKKETLEAAAGEALGQTLTVAQLDVCSDESVAQCLSCIQGEVDVLVNNAGMGLVGPLEGLSLAAMQNVFDTNFFGAVRLVKAVLPGMKRRRQGHIVVISSVMGLQGVIFNDVYAASKFALEGFFESLAIQLLQFNIFISLVEPGPVVTEFEGKLLAQVSMAEFPGTDPETLHYFRDLYLPASRKLFCSVGQNPQDVVQAIVNVISSTRPPLRRQTNIRYSPLTTLKTVDSSGSLYVRTTHRLLFRCPRLLNLGLQCLSCGCLPTRVRPR

SEQ ID NO: 11298 - protein, 79 aa, Homo Sapiens
  misc_feature (1)..(1): Xaa can be any naturally occurring amino acid
XFESLAIQLLQFNILFLWLSSQALTLRPCTTSGTSISQPPGSCFAPWDRTHRTWFRPLSTSSARLDHPCADRPTSATRR

SEQ ID NO: 11299 - protein, 166 aa, Homo Sapiens
MAQTSSYFMLISCLMFLSQSQGQEAQTELPQARISCPEGTNAYRSYCYYFNEDRETWVDADLYCQNMNSGNLVSVLTQAEGAFVASLIKESGTDDFNVWIGLHDPKKNRRWHWSSGSLVSYKSWGIGAPSSVNPGYCVSLTSSTGFQKWKDVPCEDKFSFVCKFKN

SEQ ID NO: 11300 - protein, 149 aa, Homo Sapiens
FNEDPETWVDADLYCQNMNSGNLVSVLTQAEGAFVASLIKESSTDDSNVWIGLHDPKKNRRWHWSSGSLVSYKSWDTGSPSSANAGYCASLTSCSGERQTIYPPVAISFPLISGDEHGDWDRGKDSRNGRMNLVRRSSPLFASSKTRGS

SEQ ID NO: 11301 - protein, 166 aa, Homo Sapiens
MAQTNSFFMLISSLMFLSLSQGQESQTELPNPRISCPEGTNAYRSYCYYFNEDPETWVDADLYCQNMNSGNLVSVLTQAEGAFVASLIKESSTDDSNVWIGLHDPKKNRRWHWSSGSLVSYKSWDTGSPSSANAGYCASLTSCSGFKKWKDESCEKKFSFVCKFKN

SEQ ID NO: 11302 - protein, 175 aa, Homo Sapiens
MLPPMALPSVSWMLLSCLMLLSQVQGEEPQRELPSARIRCPKGSKAYGSHCYALFLSPKSWTDADLACQKRPSGNLVSVLSGAEGSFVSSLVKSIGNSYSYVWIGLHDPTQGTEPNGEGWEWSSSDVMNYFAWERNPSTISSPGHCASLSRSTAFLRWKDYNCNVRLPYVCKFTD

SEQ ID NO: 11303 - protein, 175 aa, Homo Sapiens; identical to SEQ ID NO: 11302

SEQ ID NO: 11304 - protein, 175 aa, Homo Sapiens; identical to SEQ ID NO: 11302

SEQ ID NO: 11305 - protein, 129 aa, Homo Sapiens
MLPPMALPSVSWMLLSCLILLCQVQGEETQKELPSPRISCPKGSKAYGSPCYALFLSPKSWMDADGSEPDGDGWEWSSTDVMNYFAWEKNPSTILNPGHCGSLSRSTGFLKWKDYNCDAKLPYVCKFKD

SEQ ID NO: 11306 - protein, 175 aa, Homo Sapiens
MLPPMALPSVSWMLLSCLILLCQVQGEETQKELPSPRISCPKGSKAYGSPCYALFLSPKSWMDADLACQKRPSGKLVSVLSGAEGSFVSSLVRSISNSYSYIWIGLHDPTQGSEPDGDGWEWSSTDVMNYFAWEKNPSTILNPGHCGSLSRSTGFLKWKDYNCDAKLPYVCKFKD

SEQ ID NO: 11307 - protein, 175 aa, Homo Sapiens; identical to SEQ ID NO: 11306

SEQ ID NO: 11308 - protein, 158 aa, Homo Sapiens
MASRSMRLLLLLSCLAKTGVLGDIIMRPSCAPGWFYHKSNCYGYFRKLRNWSDAELECQSYGNGAHLASILSLKEASTIAEYISGYQRSQPIWIGLHDPQKRQQWQWIDGAMYLYRSWSGKSMGGNKHCAEMSSNNNFLTWSSNECNKRQHFLCKYRP

SEQ ID NO: 11309 - protein, 158 aa, Homo Sapiens; identical to SEQ ID NO: 11308

SEQ ID NO: 11310 - protein, 103 aa, Homo Sapiens
MASRSMRLLLLLSCLAKTGVLGDIIMRPSCAPGWFYHKSNCYGYFRKLRNWSDAELECQSYGNGAHLASILSLKEASTIAEYISGYQRSQPIWIGLHDPQKTF

SEQ ID NO: 11311 - protein, 134 aa, Homo Sapiens
MASRSMRLLLLLSCLAKTGVLGDIIMRPSCAPGWFYHKSNCYGYFRKLRNWSDAEVRNLLPAWPGLSRAKDQPEPQISFDSGSSVLPGHYEEKPLWLVKWREEGCVFNSFNSVSIAEAGAVCQTLDGLQAHTDT

SEQ ID NO: 11312 - protein, 3458 aa, Homo Sapiens
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMCSGRGICDAGRCVCDRGFGGPYCVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCGSVRFRWYQGFYPAGSQPVTWAIDNVYIGPQCEEMCNGQGSCINGTKCICDPGYSGPTCKISTKNPDFLKDDFEGQLESDRFLLMSGGKPSRKCGILSSGNNLFFNEDGLRMLMTRDLDLSHARFVQFFMRLGCGKGVPDPRSQPVLLQYSLNGGLSWSLLQEFLFSNSSNVGRYIALEIPLKARSGSTRLRWWQPSENGHFYSPWVIDQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLTRKQNYMMNFSRQHGLRHFYNRRRRSLRRYP

SEQ ID NO: 11313 - protein, 3460 aa, Homo Sapiens [sequence omitted]

SEQ ID NO: 11314 - protein, 3460 aa, Homo Sapiens
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMCSGRGICDAGRCVCDRGFGGPYCVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCGSVRFRWYQGFYPAGSQPVTWAIDNVYIGPQCEEMCNGQGSCINGTKCICDPGYSGPTCKISTKNPDFLKDDFEGQLESDRFLLMSGGKPSRKCGILSSGNNLFFNEDGLRMLMTRDLDLSHARFVQFFMRLGCGKGVPDPRSQPVLLQYSLNGGLSWSLLQEFLFSNSSNVGRYIALEIPLKARSGSTRLRWWQPSENGHFYSPWVIDQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLVSTRKQNYMMNFSRQHGLRHFYNRRRRSLRRYP

SEQ ID NO: 11315 - protein, 68 aa, Homo Sapiens
  misc_feature (1)..(1): Xaa can be any naturally occurring amino acid
XLRWWQPRHNGTGHDQWALDHVEVVLDEKSYIASKPDQTFMTNHSAACIERHFLTCVIFHYLLSLVFH

SEQ ID NO: 11316 - protein, 103 aa, Homo Sapiens
MKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGNQPCLPD

SEQ ID NO: 11317 - protein, 101 aa, Homo Sapiens
MKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGWFGPW

SEQ ID NO: 11318 - protein, 430 aa, Homo Sapiens
MKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGWFGPWGVPRVPCQPCSWAPLGTHGCDEWGRRARRGVEVAAGASSGGETRQPGNGTRAGGPEETAAQYAVIAIVPVFCLMGLLGILVCNLLKRKGYHCTAHKEVGPGPGGGGSGINPAYRTEDANEDTIGVLVRLITEKKENAAALEELLKEYHSKQLVQTSHRPVSKLPPAPPNVPHICPHRHHLHTVQGLASLSGPCCSRCSQKKWPEVLLSPEAVAATTPVPSLLPNPTRVPKAGAKAGRQGEITILSVGRFRVARIPEQRTSSMVSEVKTITEAGPSWGDLPDSPQPGLPPEQQALLGSGGSRTKWLKPPAENKAEENRYVVRLSESNLVI

SEQ ID NO: 11319 - protein, 430 aa, Homo Sapiens; identical to SEQ ID NO: 11318

SEQ ID NO: 11320 - protein, 406 aa, Homo Sapiens
MDGWRRMPRWGLLLLLWGSCTFGLPTDTTTFKRIFLKRMPSIRESLKERGVDMARLGPEWSQPMKRLTLGNTTSSVILTNYMDTQYYGEIGIGTPPQTFKVVFDTGSSNVWVPSSKCSRLYTACVYHKLFDASDSSSYKHNGTELTLRYSTGTVSGFLSQDIITVGGITVTQMFGEVTEMPALPFMLAEFDGVVGMGFIEQAIGRVTPIFDNIISQGVLKEDVFSFYYNRDSENSQSLGGQIVLGGSDPQHYEGNFHYINLIKTGVWQIQMKGVSVGSSTLLCEDGCLALVDTGASYISGSTSSIEKLMEALGAKKRLFDYVVKCNEGPTLPDISFHLGGKEYTLTSADYVFQESYSSKKLCTLAIHAMDIPPPTGPTWALGATFIRKFYTEFDRRNNRIGFALAR

SEQ ID NO: 11321 - protein, 368 aa, Homo Sapiens
MPSIRESLKERGVDMARLGPEWSQPMKRLTLGNTTSSVILTNYMDTQYYGEIGIGTPPQTFKVVFDTGSSNVWVPSSKCSRLYTACVYHKLFDASDSSSYKHNGTELTLRYSTGTVSGFLSQDIITVGGITVTQMFGEVTEMPALPFMLAEFDGVVGMGFIEQAIGRVTPIFDNIISQGVLKEDVFSFYYNRDSENSQSLGGQIVLGGSDPQHYEGNFHYINLIKTGVWQIQMKGVSVGSSTLLCEDGCLALVDTGASYISGSTSSIEKLMEALGAKKRLFDYVVKCNEGPTLPDISFHLGGKEYTLTSADYVFQESYSSKKLCTLAIHAMDIPPPTGPTWALGATFIRKFYTEFDRRNNRIGFALAR

SEQ ID NO: 11322 - protein, 394 aa, Homo Sapiens
MDGRRVPAQPAAEFSLTPGGYRSVGRSRRCSRGSIPRNIPKRSWKKPHPQLCSLQAEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPA

SEQ ID NO: 11323 - protein, 366 aa, Homo Sapiens
MDGRRVPAQPAAEFSLTPGGYRSVGRSRRCSRGSIPRNIPKRSWKKPHPQLCSLQEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNL

SEQ ID NO: 11324 - protein, 55 aa, Homo Sapiens
MDGRRVPAQPAAEQRKNRCWNVVAGAPWPWAWPSPDSFLGPPRSHPRPWGRSPAG

SEQ ID NO: 11325 - protein, 47 aa, Homo Sapiens
MDGRRVPAQPAAEVRPGQGRGATAGPRGAAPPAGRVTVRLASLQSEV

SEQ ID NO: 11326 - protein, 47 aa, Homo Sapiens; identical to SEQ ID NO: 11325

SEQ ID NO: 11327 - protein, 136 aa, Homo Sapiens
MDGRRVPAQPAAEVRPGQGRGATAGPRGAAPPAGRVTVSVRDRVRGRTDAGTSLQGPPGHGPGPAPTPFWALPGVTPDPGEGVPRAEATRHVSGPVWCPSPRQGPSLCPLSKALPWLGGSVASHPPVPGPAALALP

SEQ ID NO: 11328 - protein, 624 aa, Homo Sapiens
MGIGVSLLLQFSLTPGGYRSVGRSRRCSRGSIPRNIPKRSWKKPHPQLCSLQAEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 11329 - protein, 87 aa, Homo Sapiens
MGIGVSLLLQFSLTPGGYRSVGRSRRCSRGSIPRNIPKRSWKKPHPQLCSLQGLVIFDVSQLLHLLNRELSVCLSSFSELLCSSDVA

SEQ ID NO: 11330 - protein, 136 aa, Homo Sapiens
MGIGVSLLLQFSLTPGGYRSVGRSRRCSRGSIPRNIPKRSWKKPHPQLCSLQGSSVSVCPASQSCCAARMWHRKQQTQGEGSIRHCREQWPHFLQRKNRCWNVVAGAPWPWAWPSPDSFLGPPRSHPRPWGRSPAG

SEQ ID NO: 11331 - protein, 136 aa, Homo Sapiens; identical to SEQ ID NO: 11330

SEQ ID NO: 11332 - protein, 146 aa, Homo Sapiens
MLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIA

SEQ ID NO: 11333 - protein, 567 aa, Homo Sapiens
MLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 11334 - protein, 567 aa, Homo Sapiens; identical to SEQ ID NO: 11333

SEQ ID NO: 11335 - protein, 567 aa, Homo Sapiens; identical to SEQ ID NO: 11333

SEQ ID NO: 11336 - protein, 659 aa, Homo Sapiens
MEAAAAAAAAAAAAAAAGGGCGSGPPPLLLSEGEQQCYSELFARCAGAAGGGPGSGPPEAARVAPGTATAAAGPVADLFRASQLPAETLHQITELCGAKRVGYFGPTQFYIALKLIAAAQSGLPVRIESIKCELPLPRFMMSKNDGEIRFGNPAELHGTKVQIPYLTTEKNSFKRMDDEDKQETQSPTMSPLASPPSSPPHYQRVPLSHGYSKLRSSAEQMHPAPYEARQPLVQPEGSSSGGPGTKPLRHQASLIRSFSVERELQDNSSYPDEPWRITEEQREYYVNQFRSLQPDPSSFISGSVAKNFFTKSKLSIPELSYIWELSDADCDGALTLPEFCAAFHLIVARKNGYPLPEGLPPTLQPEYLQAAFPKPKWDCQLFDSYSESLPANQQPRDLNRMEKTSVKDMADLPVPNQDVTSDDKQALKSTINEALPKDVSEDPATPKDSNSLKARPRSRSYSSTSIEEAMKRGEDPPTPPPRPQKTHSRASSLDLNKVFQPSVPATKSGLLPPPPALPPRPCPSQSEQVSEAELLPQLSRAPSQAAESSPAKKDVLYSQPPSKPIRRKFRPENQATENQEPSTAASGPASAATMKPHPTVQKQSSKQKKAIQTAIRKNKEANAVLARLNSELQQQLKEVHQERIALENQLEQLRPVTVL

SEQ ID NO: 11337 - protein, 660 aa, Homo Sapiens
MEAAAAAAAAAAAAAAAGGGCGSGPPPLLLSEGEQQCYSELFARCAGAAGGGPGSGPPEAARVAPGTATAAAGPVADLFRASQLPAETLHQITELCGAKRVGYFGPTQFYIALKLIAAAQSGLPVRIESIKCELPLPRFMMSKNDGEIRFGNPAELHGTKVQIPYLTTEKNSFKRMDDEDKQQETQSPTMSPLASPPSSPPHYQRVPLSHGYSKLRSSAEQMHPAPYEARQPLVQPEGSSSGGPGTKPLRHQASLIRSFSVERELQDNSSYPDEPWRITEEQREYYVNQFRSLQPDPSSFISGSVAKNFFTKSKLSIPELSYIWELSDADCDGALTLPEFCAAFHLIVARKNGYPLPEGLPPTLQPEYLQAAFPKPKWDCQLFDSYSESLPANQQPRDLNRMEKTSVKDMADLPVPNQDVTSDDKQALKSTINEALPKDVSEDPATPKDSNSLKARPRSRSYSSTSIEEAMKRGEDPPTPPPRPQKTHSRASSLDLNKVFQPSVPATKSGLLPPPPALPPRPCPSQSEQVSEAELLPQLSRAPSQAAESSPAKKDVLYSQPPSKPIRRKFRPENQATENQEPSTAASGPASAATMKPHPTVQKQSSKQKKAIQTAIRKNKEANAVLARLNSELQQQLKEVHQERIALENQLEQLRPVTVL

SEQ ID NO: 11338 - protein, 181 aa, Homo Sapiens
MAKATSGAAGLRLLLLLLLPLLGKDVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFA

SEQ ID NO: 11339 - protein, 1114 aa, Homo Sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGMSDPNWPGESPVPLTRADGTNTGFPRYPNDSVYANWMLSPSAAKLMDTFDS

SEQ ID NO: 11340 - protein, 1072 aa, Homo Sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGRISHAFTRF

SEQ ID NO: 11341 - protein, 458 aa, Homo Sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCLADLTGDAVSGRDEARSSGLGSQKHPGS

SEQ ID NO: 11342 - protein, 114 aa, Homo Sapiens
  misc_feature (1)..(1): Xaa can be any naturally occurring amino acid
XDAYWEKLYVDQAAGTPLLYVHALRDAPEEVPSFRLGQHLYGTYRTRLHENNWICIQEDTGLLYLNRSLDHSSWEKLSVRNVADAPTDLTSLCRPRLSPAHRLPQGLPVTHIPS

SEQ ID NO: 11343 - protein, 191 aa, Homo Sapiens
  misc_feature (1)..(1): Xaa can be any naturally occurring amino acid
XDAYWEKLYVDQAAGTPLLYVHALRDAPEEVPSFRLGQHLYGTYRTRLHENNWICIQEDTGLLYLNRSLDHSSWEKLSVRTCSSLKPRELCFPETRPSFRIRENRPPGTFHQFRLLPVQFLCPNISVAYRLLEGECRPCGAAPQCLLLLVLLCEPLTQAIWFILHLHAISSFNIPEVPLACLPGARYCSRS

SEQ ID NO: 11344 - protein, 108 aa, Homo Sapiens
MKALCLLLLPVLGLLVSSKTLCSMEEAINERIQEVAGSLIFRAISSIGLECQSVTSRGDLATCPRGFAVTGCTCGSACGSWDVRAETTCHCQCAGMDWTGARCCRVQP

SEQ ID NO: 11345 - protein, 82 aa, Homo Sapiens
MKALCLLLLPVLGLLVSSKTLCSMEEAINERIQEVAGSLSFAVTGCTCGSACGSWDVRAETTCHCQCAGMDWTGARCCRVQP

SEQ ID NO: 11346 - protein, 82 aa, Homo Sapiens; identical to SEQ ID NO: 11345

SEQ ID NO: 11347 - protein, 111 aa, Homo Sapiens
MGPSSCLLLILIPLLQLINPGSTQCSLDSVMDKKIKDVLNSLEYSPSPISKKLSCASVKSQGRPSSCPAGMAVTGCACGYGCGSWDVQLETTCHCQCSVVDWTTARCCHLT

SEQ ID NO: 11348 - protein, 610 aa, Homo Sapiens
MWLPLVLLLAVLLLAVLCKVYLGLFSGSSPNPFSEDVKRPPAPLVTDKEARKKVLKQAFSANQVPEKLDVVVIGSGFGGLAAAAILAKAGKRVLVLEQHTKAGGCCHTFGKNGLEFDTGIHYIGRMEEGSIGRFILDQITEGQLDWAPLSSPFDIMVLEGPNGRKEYPMYSGEKAYIQGLKEKFPQEEAIIDKYIKLVKVVSSGAPHAILLKFLPLPVVQLLDRCGLLTRFSPFLQASTQSLAEVLQQLGASSELQAVLSYIFPTYGVTPNHSAFSMHALLVNHYMKGGFYPRGGSSEIAFHTIPVIQRAGGAVLTKATVQSVLLDSAGKACGVSVKKGHELVNIYCPIVVSNAGLFNTYEHLLPGNARCLPGVKQQLGTVRPGLGMTSVFICLRGTKEDLHLPSTNYYVYYDTDMDQAMERYVSMPREEAAEHIPLLFFAFPSAKDPTWEDRFPGRSTMIMLIPTAYEWFEEWQAELKGKRGSDYETFKNSFVEASMSVVLKLFPQLEGKVESVTAGSPLTNQFYLAAPRGACYGADHDLGRLHPCVMASLRAQSPIPNLYLTGQDIFTCGLVGALQGALLCSSAILKRNLYSDLKNLDSRIRAQKKKN

SEQ ID NO: 11349 - protein, 140 aa, Homo Sapiens
  misc_feature (1)..(1): Xaa can be any naturally occurring amino acid
XFHTIPVIQRAGGAVLTKATVQSVLLDSAGKACGVSVKKGHELVNIYCPIVVSNAGLFNTYEHLLPGNARCLPGKRRVCTAPLAGSPMCPLLEPTCSVWVMLLLFLAGPLIVLKQQGENATSNIILTLAFNVGETEAHTD

SEQ ID NO: 11350 - protein, 320 aa, Homo Sapiens
  misc_feature (1)..(1): Xaa can be any naturally occurring amino acid
XGRKEYPMYSGEKAYIQGLKEKFPQEEAIIDKYIKLVKVVSSGAPHAILLKFLPLPVVQLLDRCGLLTRFSPFLQASTQSLAEVLQQLGASSELQAVLSYIFPTYGVTPNHSAFSMHALLVNHYMKGGFYPRGGSSEIAFHTIPVIQRAGGAVLTKATVQSVLLDSAGKACGVSVKKGHELVNIYCPIVVSNAGLFNTYEHLLPGNARCLPGVKQQLGTVRPGLGMTSVFICLRGTKEDLHLPSTNYYVYYDTDMDQAMERYVSMPREEAAEHIPLLFFAFPSAKDPTWEDRFPGGECDCRIPTHQPVLSGCSPRCLLRG

SEQ ID NO: 11351 - protein, 399 aa, Homo Sapiens
  misc_feature (1)..(1): Xaa can be any naturally occurring amino acid
XPLVLLLAVLLLAVLCKVYLGLFSGSSPNPFSEDVKRPPAPLVTDKEARKKVLKQGVTPNHSAFSMHALLVNHYMKGGFYPRGGSSEIAFHTIPVIQRAGGAVLTKATVQSVLLDSAGKACGVSVKKGHELVNIYCPIVVSNAGLFNTYEHLLPGNARCLPGVKQQLGTVRPGLGMTSVFICLRGTKEDLHLPSTNYYVYYDTDMDQAMERYVSMPREEAAEHIPLLFFAFPSAKDPTWEDRFPGRSTMIMLIPTAYEWFEEWQAELKGKRGSDYETFKNSFVEASMSVVLKLFPQLEGKVESVTAGSPLTNQFYLAAPRGACYGADHDLGRLHPCVMASLRAQSPIPNLYLTGQDIFTCGLVGALQGALLCSSAILKRNLYSDLKNLDSRIRAQKKKN

SEQ ID NO: 11352 - protein, 255 aa, Homo Sapiens
  misc_feature (1)..(1): Xaa can be any naturally occurring amino acid
XWLPLVLLLAVLLLAVLCKVYLGLFSGSSPNPFSEDVKRPPAPLVTDKEARKKVLKQGIHYIGRMEEGSIGRFILDQITEGQLDWAPLSSPFDIMVLEGPNGRKEYPMYSGEKAYIQGLKEKFPQEEAIIDKYIKLVKVVSSGAPHAILLKFLPLPVVQLLDRCGLLTRFSPFLQASTQSLAEVLQQLGASSELQAVLSYIFPTYGVTPNHSAFSMHALLVNHYMKGGFYPRGGSSEIAFHTIPVIQRAGGAVLT

SEQ ID NO: 11353 - protein, 331 aa, Homo Sapiens
MSRARGALCRACLALAAALAALLLLPLPLPRAPAPARTPAPAPRAPPSRPAAPSLRPDDVFIAVKTTRKNHGPRLRLLLRTWISRARQQTFIFTDGDDPELELQGGDRVINTNCSAVRTRQALCCKMSVEYDKFIESGRKWFCHVDDDNYVNARSLLHLLSSFSPSQDVYLGRPSLDHPIEATERVQGGRTVTTVKFWFATGGAGFCLSRGLALKMSPWASLGSFMSTAEQVRLPDDCTVGYIVEGLLGARLLHSPLFHSHLENLQRLPPDTLLQQVTLSHGGPENPHNVVNVAGGFSLHQDPTRFKSIHCLLYPDTDWCPRQKQGAPTSR

SEQ ID NO: 11354 - protein, 60 aa, Homo Sapiens
MSVEYDKFIESGRKWFCHVDDDNYVNARSLLHLLSSFSPSQDVYLGRPSLDHPIEATERV

SEQ ID NO: 11355 - protein, 205 aa, Homo Sapiens
MSVEYDKFIESGRKWFCHVDDDNYVNARSLLHLLSSFSPSQDVYLGRPSLDHPIEATERVQGGRTVTTVKFWFATGGAGFCLSRGLALKMSPWASLGSFMSTAEQVRLPDDCTVGYIVEGLLGARLLHSPLFHSHLENLQRLPPDTLLQQVTLSHGGPENPHNVVNVAGGFSLHQDPTRFKSIHCLLYPDTDWCPRQKQGAPTSR

SEQ ID NO: 11356 - protein, 137 aa, Homo Sapiens
MKPPAAQGSPAAAAAAAPALDSAAAEDLSDALCEFDAVLADFASPFHERHFHYEEHLERMKRRSSASVSDSSGFSDSESADSLYRNSFSFSDEKLNSPTDSTPALLSATVTPQKAKLGDTKELEAFIADLDKTLASM

SEQ ID NO: 11357 - protein, 337 aa, Homo Sapiens
MPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKAGSFKVATQERNPQRVQMRLRRQKKGVVPFLGDFLTELQRLDSAIPDDLDGNTNKRSKEVRVLQEMQLLQVAAMNYRLRPLEKFVTYFTRMEQLSDKESYKLSCQLEPENP

SEQ ID NO: 11358 - protein, 356 aa, Homo Sapiens
MPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKAGSFKVATQERNPQRVQMRLRRQKKGVVPFLGDFLTELQRLDSAIPDDLDGNTNKRSKEVRVLQEMQLLQVAAMNYRLRPLEKFVTYFTRMEQLSDKERWGFTMMSRIVSNSWPQAIHPPQPPKVLTLQV

SEQ ID NO: 11359 - protein, 410 aa, Homo Sapiens
MPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKAGSFKVATQERNPQRVQMRLRRQKKGVVPFLGDFLTELQRLDSAIPDDLDGNTNKRSKEVRVLQEMQLLQVAAMNYRLRPLEKFVTYFTRMEQLSDKERLHCSVTISVHCNVCLLGSSPSSASQAAGTTAVHHHVRLFCCCCSATSCPASWSPKTRRLATSCSGWEPTGMLARTPALHHPSPRP

SEQ ID NO: 11360 - protein, 473 aa, Homo Sapiens
MRKLLTNLPAAAVLSAQVYSAVLQGLWEENVCGTPGRTRVCTALLYGQVCPFQDSTDGLRTITSILFNWPPENTSVYYQPPQRSSFRIKLAFRNLSWPGLGLEDHQEIVLGQLVLPEPNEAKPDDPAPRPGQHALTMPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKAGSFKVATQERNPQRVQMRLRRQKKGVVPFLGDFLTELQRLDSAIPDDLDGNTNKRSKEVRVLQEMQLLQVAAMNYRLRPLEKFVTYFTRMEQLSDKESYKLSCQLEPENP

SEQ ID NO: 11361 - protein, 536 aa, Homo Sapiens
MRKLLTNLPAAAVLSAQVYSAVLQGLWEENVCGTPGRTRVCTALLYGQVCPFQDSTDGLRTITSILFNWPPENTSVYYQPPQRSSFRIKLAFRNLSWPGLGLEDHQEIVLGQLVLPEPNEAKPDDPAPRPGQHALTMPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKAGSFKVATQERNPQRVQMRLRRQKKGVVPFLGDFLTELQRLDSAIPDDLDGNTNKRSKEVRVLQEMQLLQVAAMNYRLRPLEKFVTYFTRMEQLSDKERWGFTMMSRIVSNSWPQAIHPPQPPKVLTLQLQAVLPAGARKPVGWQHPAVAGNPPGCWPEHRLCTIPHPDRRHQG

SEQ ID NO: 11362 - protein, 435 aa, Homo Sapiens
MRKLLTNLPAAAVLSAQVYSAVLQGLWEENVCGTPGRTRVCTALLYGQVCPFQDSTDGLRTITSILFNWPPENTSVYYQPPQRSSFRIKLAFRNLSWPGLGLEDHQEIVLGQLVLPEPNEAKPDDPAPRPGQHALTMPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKRDDGENNGNSYRKLSPQRPCEVAVVCITLYRRGNSLREARLQDWVTHTGSVDLGQWRGALRWPPRRGTPRESR

SEQ ID NO: 11363 - protein, 155 aa, Homo Sapiens
  misc_feature (1)..(1): Xaa can be any naturally occurring amino acid
XWASGMSTVPGGSRHSLGIQVRGGWGVTGGEEESLTVPVADTWQAGSFKVATQERNPQRVQMRLRRQKKGVVPFLGDFLTELQRLDSAIPDDLDGNTNKRSKEVRVLQEMQLLQVAAMNYRLRPLEKFVTYFTRMEQLSDKESYKLSCQLEPENP

SEQ ID NO: 11364 - protein, 458 aa, Homo Sapiens
MGGLGPRRAGTSRERLVVTGRAGWMGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 11365 - protein, 10 aa, Homo Sapiens
MGMGRGAGRS

SEQ ID NO: 11366 - protein, 46 aa, Homo Sapiens
MGMGRGAGRSALGFWPTLAFLLCSFPAAHHHLQELPGVCGPEGVPG

SEQ ID NO: 11367 - protein, 61 aa, Homo Sapiens
MGMGRGAGRSALGFWPTLAFLLCSFPAAIKRSPGSFCAALEMRRLWNLMSWKERRVQKPLM

SEQ ID NO: 11368 - protein, 90 aa, Homo Sapiens
MGMGRGAGRSALGFWPTLAFLLCSFPAATSPCKILKCNSEFWSATSGSHAPASDDTPEFCAALRSYALCTRRTARTCRGDLAYHSAVHGI

SEQ ID NO: 11369 - protein, 434 aa, Homo Sapiens
MGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 11370 - protein, 434 aa, Homo Sapiens; identical to SEQ ID NO: 11369

SEQ ID NO: 11371 - protein, 434 aa, Homo Sapiens; identical to SEQ ID NO: 11369

SEQ ID NO: 11372 - protein, 450 aa, Homo Sapiens
MQPPRERLVVTGRAGWMGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 11373 - protein, 341 aa, Homo Sapiens
MSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 11374 - protein, 437 aa, Homo Sapiens
MGLRAAPSSAAAAAAEVEQRRSPGLCPPPLELLLLLLFSLGLLHAGDCQQPAQCRIQKCTTDFVSLTSHLNSAVDGFDSEFCKALRAYAGCTQRTSKACRGNLVYHSAVLGISDLMSQRNCSKDGPTSSTNPEVTHDPCNYHSHAGAREHRRGDQNPPSYLFCGLFGDPHLRTFKDNFQTCKVEGAWPLIDNNYLSVQVTNVPVVPGSSATATNKITIIFKAHHECTDQKVYQAVTDDLPAAFVDGTTSGGDSDAKSLRIVERESGHYVEMHARYIGTTVFVRQVGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVSLGLTCLILIVFL

SEQ ID NO: 11375 - protein, 478 aa, Homo Sapiens
MIRKKRKRSAPPGPCRSHGPRPATAPAPPPSPEPTRPAWTGMGLRAAPSSAAAAAAEVEQRRSPGLCPPPLELLLLLLFSLGLLHAGDCQQPAQCRIQKCTTDFVSLTSHLNSAVDGFDSEFCKALRAYAGCTQRTSKACRGNLVYHSAVLGISDLMSQRNCSKDGPTSSTNPEVTHDPCNYHSHAGAREHRRGDQNPPSYLFCGLFGDPHLRTFKDNFQTCKVEGAWPLIDNNYLSVQVTNVPVVPGSSATATNKITIIFKAHHECTDQKVYQAVTDDLPAAFVDGTTSGGDSDAKSLRIVERESGHYVEMHARYIGTTVFVRQVGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVSLGLTCLILIVFL

SEQ ID NO: 11376 - protein, 50 aa, Homo Sapiens
MAHGPGALMLKCVVVGDGAVGKTCLLMSYANDAFPEEYVPTVFDHYAGRL

SEQ ID NO: 11377 - protein, 205 aa, Homo Sapiens
MAHGPGALMLKCVVVGDGAVGKTCLLMSYANDAFPEEYVPTVFDHYAVSVTVGGKQYLLGLYDTAGQEDYDRLRPLSYPMTDVFLICFSVVNPASFQNVKEEWVPELKEYAPNVPFLLIGTQIDLRDDPKTLARLNDMKEKPICVEQGQKLAKEIGACCYVECSALTQKGLKTVFDEAIIAILTPKKHTVKKRIGSRCINCCLIT

SEQ ID NO: 11378 - protein, 75 aa, Homo Sapiens
MTDVFLICFSVVNPASFQNVKEEWVPELKEYAPNVPFLLIGTQIDLRDDPKTLARLNDMKEKPICVEQGQKLAKE

SEQ ID NO: 11379 - protein, 91 aa, Homo Sapiens
PEEYVPTVFDHYAVSVTVGGKQYLLGLYDTAGQALQQSELDFWEEISVSSGSWGHVITFSFHTRAWVSSGQDLLCPLAPASAVLLLDRGRL

SEQ ID NO: 11380 - protein, 34 aa, Homo Sapiens
  misc_feature (1)..(1): Xaa can be any naturally occurring amino acid
XGGKQYLLGLYDTAGQEDTGELAVRSCDFDKSIF

SEQ ID NO: 11381 - protein, 45 aa, Homo Sapiens
MAYSTVQRVALASGLVLALSLLLPKAFLSRGKRQEPPPTPEEHRL

SEQ ID NO: 11382 - protein, 43 aa, Homo Sapiens
MAYSTVQRVALASGLVLALSLLLPKAFLSRGKRQEPPPTPEEN

SEQ ID NO: 11383 - protein, 288 aa, Homo Sapiens
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKLSKGKTTAEDGKCYTAMPGNTHRKISYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 11384 - protein, 368 aa, Homo Sapiens
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKLSKGKTTAEDGKCYTAMPGNTHRKITSFELAQLQEKLKETEAAMEKLINRVGPNGERAQTVTSDQEKRLLHQLREITRVMKEGKFIDRFSPEKEAEEAPYMEDWEGYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 11385 - protein, 369 aa, Homo Sapiens
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKLSKGKTTAEDGKCYTAMPGNTHRKITSFELAQLQEKLKETEAAMEKLINRVGPNGESRAQTVTSDQEKRLLHQLREITRVMKEGKFIDRFSPEKEAEEAPYMEDWEGYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 11386 - protein, 328 aa, Homo Sapiens
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKLSKGKTTAEDGKCYTAMPGNTHRKITSFELAQLQEKLKETEAAMEKLINRVGPNGESTQTDHSDVYVHCLGVFTTKWLDCLIFLSRAQTVTSDQEKRLLHQLREITRVMKEGKFIDRFSPEKEAEEAPYMEDWEGYPEETYPIYDLSDCIKRRQETILVDYPDPKELSAEEIAERMGMIEEEESDHLGWESLPTDPRAQEDNSVTSCDPKP

SEQ ID NO: 11387 - protein, 128 aa, Homo Sapiens
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKVSRIILIILHQ

SEQ ID NO: 11388 - protein, 187 aa, Homo Sapiens
MAYSTVQRVALASGLVLALSLLLPKAFLSRGKRQEPPPTPEGYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 11389 - protein, 42 aa, Homo Sapiens
MSSLIRRVISTAKAPGAIGPYRTDRHGPFKWTACVRRGSRRS

SEQ ID NO: 11390 - protein, 137 aa, Homo Sapiens
MSSLIRRVISTAKAPGAIGPYSQAVLVDRTIYISGQIGMDPSSGQLVSGGVAEEAKQALKNMGEILKAAGCDFTNVVKTTVLLADINDFNTVNEIYKQYFKSNFPARAAYQVAALPKGSRIEIEAVAIQGPLTTASL

SEQ ID NO: 11391 - protein, 148 aa, Homo Sapiens
  misc_feature (1)..(1): Xaa can be any naturally occurring amino acid
XGRLSHVVLDQKGDQHRESPRGHWTLQLSVYCSQAVLVDRTIYISGQIGMDPSSGQLVSGGVAEEAKQALKNMGEILKAAGCDFTNVVKTTVLLADINDFNTVNEIYKQYFKSNFPARAAYQVAALPKGSRIEIEAVAIQGPLTTASL

SEQ ID NO: 11392 - protein, 127 aa, Homo Sapiens
  misc_feature (1)..(1): Xaa can be any naturally occurring amino acid
XSSKKPAGLVLGLLLLKGLQEGRLSHVVLDQKGDQHRESPRGHWTLQALKNMGEILKAAGCDFTNVVKTTVLLADINDFNTVNEIYKQYFKSNFPARAAYQVAALPKGSRIEIEAVAIQGPLTTASL

SEQ ID NO: 11393 - protein, 219 aa, Homo Sapiens
MAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 11394 - protein, 1012 aa, Homo Sapiens
MCAPGIHVSSEGWEEVRSVDSEEGTIEARRAVAGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERHSRKSERSSIQKQTRKGTASDAERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 11395 - protein, 817 aa, Homo Sapiens
MCAPGIHVSSEGWEEVRSVDSEEGTIEARRAVAGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 11396 - protein, 826 aa, Homo Sapiens
MFAGFLQFLLLHTLHSGTGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERHSRKSERSSIQKQTRKGTASDAERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 11397 - protein, 753 aa, Homo Sapiens
MPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACI

SEQ ID NO: 11398 - protein, 760 aa, Homo Sapiens
MPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERHSRKSERSSIQKQTRKGTASDAERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 11399 - protein, 1541 aa, Homo Sapiens
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRHLVRHYKTLPPKMPLLQSSSHWNIYSELQPFLDRARSASTNCLRPDTSLHSPERERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 11400 - protein, 1291 aa, Homo Sapiens
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDRMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 11401 - protein, 1342 aa, Homo Sapiens
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 11402 - protein, 1371 aa, Homo Sapiens
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERGRWSPSLDRRRPPSPRIQIQHASPENDRMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 11403 - protein, 1692 aa, Homo Sapiens
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRHLVRHYKTLPPKMPLLQSSSHWNIYSSILPAHTKTKSVTRQDISLHHECFNSTVLRFTDEILVSELQPFLDRARSASTNCLRPDTSLHSPERERGRWSPSLDRRRPPSPRIQIQHASPENDRHSRKSERSSIQKQTRKGTASDAERVLPTCLSRRGHAAPRATDQPVIRGKHPARSRSSEHSSIRTLCSMHHLVPGGSAPPSPLLTRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 11404 - protein, 1481 aa, Homo Sapiens
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 11405 - protein, 1475 aa, Homo Sapiens
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRIRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 11406 - protein, 740 aa, Homo Sapiens
RPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 11407 - protein, 610 aa, Homo Sapiens
  misc_feature (1)..(1): Xaa can be any naturally occurring amino acid
XDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRHSRKSERSSIQKQTRKGTASDAERMHRQRSPTQSPPADTSFSSRRGRQLPQVPVRSGSIEQEQEKYNSSTKASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 11408 - protein, 1038 aa, Homo Sapiens
  misc_feature (1)..(1): Xaa can be any naturally occurring amino acid
XYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 11409 - protein, 151 aa, Homo Sapiens
MDSAACAAAATPVPALALALAPDLAQAPLALPGLLSPSCLLSSGQEVNGSERGTCLWRPWLSSTNDSPRQMRKLVDLAAGGATAAEVTKAESKFHHPVRLFWPKSRSFDYLYSAGEILLQNFPVQATINLYEDSDSEEEEEDEEQEDEEEK

SEQ ID NO: 11410 - protein, 104 aa, Homo Sapiens
MDSAACAAAATPVPALALALAPDLAQAPLALPGLLSPSCLLSSGQEVNGSERLFWPKSRSFDYLYSAGEILLQNFPVQATINLYEDSDSEEEEEDEEQEDEEEK

SEQ ID NO: 11411 - protein, 185 aa, Homo Sapiens
MPRLFLFHLLEFCLLLNQFSRAVAAKWKDDVIKLCGRELVRAQIAICGMSTWSKRSLSQEDAPQTPRPVAEIVPSFINKDTETIIIMLEFIANLPPELKAALSERQPSLPELQQYVPALKDSNLSFEEFKKLIRNRQSEAADSNPSELKYLGLDTHSQKKRRPYVALFEKCCLIGCTKRSLAKYC

SEQ ID NO: 11412 - protein, 185 aa, Homo Sapiens
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFC

SEQ ID NO: 11413 - protein, 68 aa, Homo Sapiens
  misc_feature (1)..(1): Xaa can be any naturally occurring amino acid
XTWSKRSLSQEDAPQTPRPVAGDFIQTVSLGISPDGGKALRTGSCFTREFLGALSKLCHPSSTKIQKP

SEQ ID NO: 11414 - protein, 109 aa, Homo Sapiens
MARYMLLLLLAVWVLTGELWPGAEARAAPYGVRLCGREFIRAVIFTCGGSRWRRSDILAHEAMEKNIEAPRSKFTCSRLEKLDSCSVSPAPKCTRSSINKERYLPGCRC

SEQ ID NO: 11415 - protein, 142 aa, Homo Sapiens
MARYMLLLLLAVWVLTGELWPGAEARAAPYGVRLCGREFIRAVIFTCGGSRWRRSDILAHEAMGDTFPDADADEDSLAGELDEAMGSSEWLALTKSPQAFYRGRPSWQGTPGVLRGSRDVLAGLSSSCCKWGCSKSEISSLC

SEQ ID NO: 11416 - protein, 165 aa, Homo Sapiens
EEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQGKTYLKLHNKKLAAFWLMKAKDYPAHTEEDKQIQTEAAQLLTSFSEKN

SEQ ID NO: 11417 - protein, 108 aa, Homo Sapiens
MALAARLWRLLPFRRGAAPGSRLPAGTSGSRGHCGPCRFRGFEVMGNPGTFKRGLLLSALSYLGFETYQVISQAAVVHATAKESRCVTEGRVWRCDLSSLQPLPPGFK

SEQ ID NO: 11418 - protein, 271 aa, Homo Sapiens
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKKAIELNPKDATSIHLMGIWCYTFAEMPWYQRRIAKMLFATPPSSTYEKALGYFHRAEQGKTYLKLHNKKLAAFWLMKAKDYPAHTEEDKQIQTEAAQLLTSFSEKN

SEQ ID NO: 11419 - protein, 284 aa, Homo Sapiens
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQIQTEAAQLLTSFSEKN

SEQ ID NO: 11420 - protein, 314 aa, Homo Sapiens
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQIQTEAAQLLTSFSEKN

SEQ ID NO: 11421 - protein, 64 aa, Homo Sapiens
MGNPGTFKRGLLLSALSYLGFETYQVISQAAVVHATAKESRCVTEGRVWRCDLSSLQPLPPGFK

SEQ ID NO: 11422 - protein, 95 aa, Homo Sapiens
MGNPGTFKRGLLLSALSYLGFETYQVISQAAVVHATAKVEEILEQADYLYESGETEKLYQLLTQYKESEDAELLWRLARASRDVAQLSRTSEEEK

SEQ ID NO: 11423 - protein, 248 aa, Homo Sapiens
MGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQGKTYLKLHNKKLAAFWLMKAKDYPAHTEEDKQVKRNRSS

SEQ ID NO: 11424 - protein, 42 aa, Homo Sapiens
MGNPGTFKRGLLLSALSYLGFETYQVISQAAVVHATAKVRQY

SEQ ID NO: 11425 - protein, 159 aa, Homo Sapiens
  misc_feature (1)..(1): Xaa can be any naturally occurring amino acid
XCYTFAEMPWYQRRIAKMLFATPPSSTYEKALGYFHRAEQVDPNFYSKNLLLLGKTYLKLHNKKLAAFWLMKAKDYPAHTEEDKQEPDSPRVTLVRDVSPLRVRPITENKPQESLTFSFPCSPHLIVLVWIPELTAGLRCLFPHVHVYQRFCVASPSAS

SEQ ID NO: 11426 - protein, 107 aa, Homo Sapiens
  misc_feature (1)..(1): Xaa can be any naturally occurring amino acid
XKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQEII

SEQ ID NO: 11427 - protein, 151 aa, Homo Sapiens
  misc_feature (1)..(1): Xaa can be any naturally occurring amino acid
XKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQVKRNRSS

SEQ ID NO: 11428 - protein, 130 aa, Homo Sapiens
  misc_feature (1)..(1): Xaa can be any naturally occurring amino acid
XKTYLKLHNKKLAAFWLMKAKDYPAHTEEDKQEPDSPRVTLVRDVSPLRVRPITENKPQESLTFSFPCSPHLIVLVWIPELTAGLRCLFPHVHVYQSLKITRVFIIRIWKRSLFNQADLCLSFVFTMNSE

SEQ ID NO: 11429 - protein, 225 aa, Homo Sapiens
  misc_feature (1)..(1): Xaa can be any naturally occurring amino acid
XLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQGEEKQKQLKGQEVGLSRDVAFCWMAF

SEQ ID NO: 11430 - protein, 156 aa, Homo Sapiens
MALEKSLVRLLLLVLILLVLGWVQPSLGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 11431 - protein, 156 aa, Homo Sapiens; identical to SEQ ID NO: 11430

SEQ ID NO: 11432 - protein, 156 aa, Homo Sapiens; identical to SEQ ID NO: 11430

SEQ ID NO: 11433 - protein, 156 aa, Homo Sapiens; identical to SEQ ID NO: 11430

SEQ ID NO: 11434 - protein, 116 aa, Homo Sapiens
MDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 11435 - protein, 216 aa, Homo Sapiens
MKLNLVQIFFMLLMLLLGLGMGLGLGLHMATAVLEESDQPLNEFWSSDSQDKAEATEEGDGTQTTETLVLSNKEVVQPGWPEDPILGEDEVGGNKMLRASALFQSNKDYLRLDQTDRECNDMMAHKMKEPSQSCIAQYAFIHEDLNTVKAVCNSPVIACELKGGKCHKSSRPFDLTLCELSQPDQVTPNCNYLTSVIKKHIIITCNDMKRQLPTGQ

SEQ ID NO: 11436 - protein, 244 aa, Homo Sapiens
MWGAPLPRRPVWDVRSASAGPQPCLGGKMKLNLVQIFFMLLMLLLGLGMGLGLGLHMATAVLEESDQPLNEFWSSDSQDKAEATEEGDGTQTTETLVLSNKEVVQPGWPEDPILGEDEVGGNKMLRASALFQSNKDYLRLDQTDRECNDMMAHKMKEPSQSCIAQYAFIHEDLNTVKAVCNSPVIACELKGGKCHKSSRPFDLTLCELSQPDQVTPNCNYLTSVIKKHIIITCNDMKRQLPTGQ

SEQ ID NO: 11437 - protein, 136 aa, Homo Sapiens
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPS

SEQ ID NO: 11438 - protein, 143 aa, Homo Sapiens
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNP

SEQ ID NO: 11439 - protein, 171 aa, Homo Sapiens
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQY

SEQ ID NO: 11440 - protein, 178 aa, Homo Sapiens
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLE

SEQ ID NO: 11441 - protein, 178 aa, Homo Sapiens; identical to SEQ ID NO: 11440

SEQ ID NO: 11442 - protein, 199 aa, Homo Sapiens
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLEKILTVLTGHSLMSWLVCGSKL

SEQ ID NO: 11443 - protein, 199 aa, Homo Sapiens; identical to SEQ ID NO: 11442

SEQ ID NO: 11444 - protein, 199 aa, Homo Sapiens; identical to SEQ ID NO: 11442

SEQ ID NO: 11445 - protein, 199 aa, Homo Sapiens; identical to SEQ ID NO: 11442

SEQ ID NO: 11446 - protein, 199 aa, Homo Sapiens; identical to SEQ ID NO: 11442

SEQ ID NO: 11447 - protein, 199 aa, Homo Sapiens; identical to SEQ ID NO: 11442

SEQ ID NO: 11448 - protein, 147 aa, Homo Sapiens
MIIMVIIFLVLLFWENEVNDEAVMSTLEHLHVDYPQNDVPVPARYCNHMIIQRVIREPDHTCKKEHVFIHERPRKINGICISPKKVACQNLSAIFCFQSETKFKMTVCQLIEGTRYPACRYHYSPTEGFVLVTCDDLRPDSFLGYVK

SEQ ID NO: 11449 - protein, 156 aa, Homo Sapiens
MAPAVTRLLFLQLVLGPTLVMDIKMQIGSRNFYTLSIDYPRVNYPKGFRGYCNGLMSYMRGKMQNSDCPKIHYVIHAPWKAIQKFCKYSDSFCENYNEYCTLTQDSLPITVCSLSHQQPPTSCYYNSTLTNQKLYLLCSRKYEADPIGIAGLYSGI

SEQ ID NO: 11450 - protein, 161 aa, Homo Sapiens
MVPKLFTSQICLLLLLGLLAVEGSLHVKPPQFTWAQWFETQHINMTSQQCTNAMQVINNYQRRCKNQNTFLLTTFANVVNVCGNPNMTCPSNKTRKNCHHSGSQVPLIHCNLTTPSPQNISNCRYAQTPANMFYIVACDNRDQRRDPPQYPVVPVHLDRII

SEQ ID NO: 11451 - protein, 160 aa, Homo Sapiens
MVPKLFTSQICLLLLLGLMGVEGSLHARPPQFTRAQWFAIQHISLNPPRCTIAMRAINNYRWRCKNQNTFLRTTFANVVNVCGNQSIRCPHNRTLNNCHRSRFRVPLLHCDLINPGAQNISNCTYADRPGRRFYVVACDNRDPRDSPRYPVVPVHLDTTI

SEQ ID NO: 11452 - protein, 147 aa, Homo Sapiens
MALQRTHSLLLLLLLTLLGLGLVQPSYGQDGMYQRFLRQHVHPEETGGSDRYCNLMMQRRKMTLYHCKRFNTFIHEDIWNIRSICSTTNIQCKNGKMNCHEGVVKVTDCRDTGSSRAPNCRYRAIASTRRVVIACEGNPQVPVHFDG

SEQ ID NO: 11453 - protein, 147 aa, Homo Sapiens; identical to SEQ ID NO: 11452

SEQ ID NO: 11454 - protein, 147 aa, Homo Sapiens; identical to SEQ ID NO: 11452

SEQ ID NO: 11455 - protein, 150 aa, Homo Sapiens
MVLCFPLLLLLLVLWGPVCPLHAWPKRLTKAHWFEIQHIQPSPLQCNRAMSGINNYTQHCKHQNTFLHDSFQNVAAVCDLLSIVCKNRRHNCHQSSKPVNMTDCRLTSGKYPQCRYSAAAQYKFFIVACDPPQKSDPPYKLVPVHLDSIL

SEQ ID NO: 11456 - protein, 156 aa, Homo Sapiens
MAPARAGFCPLLLLLLLGLWVAEIPVSAKPKGMTSSQWFKIQHMQPSPQACNSAMKNINKHTKRCKDLNTFLHEPFSSVAATCQTPKIACKNGDKNCHQSHGAVSLTMCKLTSGKHPNCRYKEKRQNKSYVVACKPPQKKDSQQFHLVPVHLDRVL

SEQ ID NO: 11457 - protein, 156 aa, Homo Sapiens; identical to SEQ ID NO: 11456

SEQ ID NO: 11458 - protein, 154 aa, Homo Sapiens
MAPARAGCCPLLLLLLGLWVAEVLVRAKPKDMTSSQWFKTQHVQPSPQACNSAMSIINKYTERCKDLNTFLHEPFSSVAITCQTPNIACKNSCKNCHQSHGPMSLTMGELTSGKYPNCRYKEKHLNTPYIVACDPPQQGDPGYPLVPVHLDKVV

SEQ ID NO: 11459 - protein, 205 aa, Homo Sapiens
MMRTLITTHPLPLLLLPQQLLQLVQFQEVDTDFDFPEEDKKEEFEECLEKFFSTGPARPPTKEKVKRRVLIEPGMPLNHIEYCNHEIMGKNVYYKHRWVAEHYFLLMQYDELQKICYNRFVPCKNGIRKCNRSKGLVEGVYCNLTEAFEIPACKYESLYRKGYVLITCSWQNEMQKRIPHTINDLVEPPEHRSFLSEDGVFVISP

SEQ ID NO: 11460 - protein, 205 aa, Homo Sapiens; identical to SEQ ID NO: 11459

SEQ ID NO: 11461 - protein, 205 aa, Homo Sapiens; identical to SEQ ID NO: 11459

SEQ ID NO: 11462 - protein, 205 aa, Homo Sapiens; identical to SEQ ID NO: 11459

SEQ ID NO: 11463 - protein, 205 aa, Homo Sapiens; identical to SEQ ID NO: 11459

SEQ ID NO: 11464 - protein, 205 aa, Homo Sapiens; identical to SEQ ID NO: 11459

SEQ ID NO: 11465 - protein, 210 aa, Homo Sapiens
MSAGKMMRTLITTHPLPLLLLPQQLLQLVQFQEVDTDFDFPEEDKKEEFEECLEKFFSTGPARPPTKEKVKRRVLIEPGMPLNHIEYCNHEIMGKNVYYKHRWVAEHYFLLMQYDELQKICYNRFVPCKNGIRKCNRSKGLVEGVYCNLTEAFEIPACKYESLYRKGYVLITCSWQNEMQKRIPHTINDLVEPPEHRSFLSEDGVFVISP

SEQ ID NO: 11466 - protein, 210 aa, Homo Sapiens; identical to SEQ ID NO: 11465

SEQ ID NO: 11467 - protein, 210 aa, Homo Sapiens; identical to SEQ ID NO: 11465

SEQ ID NO: 11468 - protein, 210 aa, Homo Sapiens; identical to SEQ ID NO: 11465

SEQ ID NO: 11469 - protein, 210 aa, Homo Sapiens; identical to SEQ ID NO: 11465

SEQ ID NO: 11470 - protein, 43 aa, Homo Sapiens
MSWLLFLAHRVALAALPCRRGSRGFGMFYAVRRGRKTGVFLTC

SEQ ID NO: 11471 - protein, 43 aa, Homo Sapiens
MSWLLFLAHRVALAALPCRRGSRGFGMFYAVRRGRKTGVFLTW

SEQ ID NO: 11472 - protein, 286 aa, Homo Sapiens
MSWLLFLAHRVALAALPCRRGSRGFGMFYAVRRGRKTGVFLTWNECRAQVDRFPAARFKKFATEDEAWAFVRKSASPEVSEGHENQHGQESEAKASKRLREPLDGDGHESAEPYAKHMKPSVEPAPPVSRDTFSYMGDFVVVYTDGCCSSNGRRRPRAGIGVYWGPGHPLNVGIRLPGRQTNQRAEIHAACKAIEQAKTQNINKLVLYTDSMFTINGITNWVQGWKKNGWKTSAGKEVINKEDFVALERLTQGMDIQWMHVPGHSGFIGNEEADRLAREGAKQSED

SEQ ID NO: 11473 - protein, 254 aa, Homo Sapiens
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKT

SEQ ID NO: 11474 - protein, 256 aa, Homo Sapiens
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKTKH

SEQ ID NO: 11475 - protein, 256 aa, Homo Sapiens; identical to SEQ ID NO: 11474

SEQ ID NO: 11476 - protein, 238 aa, Homo Sapiens
MRPAALRGALLGCLCLALLCLGGADKRLRDNHEWKKLIMVQHWPETVCEKIQNDCRDPPDYWTIHGLWPDKSEGCNRSWPFNLEEIKKNWMEITDSSLPSPSMGPAPPRWMRSTPRRSTLAEAWNSTGSWTSTGGCALPPAALPSGDLCCRPSLTAGSRGVGVDLTALQQLLHVHYSATGIIPEECSEPTKPFQIILHHDHTEWVQSIGMPIWTISSSESAIGKTRTQPACAVLSHDS

SEQ ID NO: 11477 - protein, 121 aa, Homo Sapiens
MRPAALRGALLGCLCLALLCLGGADKRLRDNHEWKKLIMVQHWPETVCEKIQNDCRDPPDYWTIHGLWPDKSEGCNRSWPFNLEEIKKNWMEITDSSLPSPSTLPIINIFYSVLHLLQLMN

SEQ ID NO: 11478 - protein, 306 aa, Homo Sapiens [sequence omitted]

SEQ ID NO: 11479 - protein, 71 aa, Homo Sapiens
MRPAALRGALLGCLCLALLCLGGADKRLRDNHEWKKLIMVQHWPETVCEKIQNDCRDPPDYWTIHGLWQAR

SEQ ID NO: 11480 - protein, 218 aa, Homo Sapiens
MVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKTKH

SEQ ID NO: 11481 - protein, 9 aa, Homo Sapiens
MAGCGEIDH

SEQ ID NO: 11482 - protein, 358 aa, Homo Sapiens
MAGCGEIDHSINMLPTNRKANESCSNTAPSLTVPECAICLQTCVHPVSLPCKHVFCYLCVKGASWLGKRCALCRQEIPEDFLDKPTLLSPEELKAASRGNGEYAWYYEGRNGWWQYDERTSRELEDAFSKGKKNTEMLIAGFLYVADLENMVQYRRNEHGRRRKIKRDIIDIPKKGVAGLRLDCDANTVNLARESSADGADSVSAQSGASVQPLVSSVRPLTSVDGQLTSPATPSPDASTSLEDSFAHLQLSGDNTAERSHRGEGEEDHESPSSGRVPAPDTSIEETESDASSDSEDVSAVVAQHSLTQQRLLVSNANQTVPDRSDRSGTDRSVAGGGTVSVSVRSRRPDGQCTVTEV

SEQ ID NO: 11483 - protein, 358 aa, Homo Sapiens; identical to SEQ ID NO: 11482

SEQ ID NO: 11484 - protein, 14 aa, Homo Sapiens
MCWGSSIFMLFSPL

SEQ ID NO: 11485 - protein, 42 aa, Homo Sapiens
MCWGSSIFMLFSPLVLYDCYLYEALVITKHFFCPFLPELCKL

SEQ ID NO: 11486 - protein, 42 aa, Homo Sapiens; identical to SEQ ID NO: 11485

SEQ ID NO: 11487 - protein, 42 aa, Homo Sapiens; identical to SEQ ID NO: 11485

SEQ ID NO: 11488 - protein, 40 aa, Homo Sapiens
MGSSIFMLFSPLVLYDCYLYEALVITKHFFCPFLPELCKL

SEQ ID NO: 11489 - protein, 40 aa, Homo Sapiens; identical to SEQ ID NO: 11488

SEQ ID NO: 11490 - protein, 359 aa, Homo Sapiens
MMAGCGEIDHSINMLPTNRKANESCSNTAPSLTVPECAICLQTCVHPVSLPCKHVFCYLCVKGASWLGKRCALCRQEIPEDFLDKPTLLSPEELKAASRGNGEYAWYYEGRNGWWQYDERTSRELEDAFSKGKKNTEMLIAGFLYVADLENMVQYRRNEHGRRRKIKRDIIDIPKKGVAGLRLDCDANTVNLARESSADGADSVSAQSGASVQPLVSSVRPLTSVDGQLTSPATPSPDASTSLEDSFAHLQLSGDNTAERSHRGEGEEDHESPSSGRVPAPDTSIEETESDASSDSEDVSAVVAQHSLTQQRLLVSNANQTVPDRSDRSGTDRSVAGGGTVSVSVRSRRPDGQCTVTEV

SEQ ID NO: 11491 - protein, 359 aa, Homo Sapiens; identical to SEQ ID NO: 11490

SEQ ID NO: 11492 - protein, 359 aa, Homo Sapiens; identical to SEQ ID NO: 11490

SEQ ID NO: 11493 - protein, 101 aa, Homo Sapiens
MSFLRITPSTHSSVSSGLLRLSIFLLLSFPDSNGKAIWTAHLNITFQGTENIVAVMISNLKGMEILHSIQKGVYVTVIIEVGRMHMQWEAKSNKDRCEESY

SEQ ID NO: 11494 - protein, 305 aa, Homo Sapiens
MSFLRITPSTHSSVSSGLLRLSIFLLLSFPDSNGKAIWTAHLNITFQVGNEITSELGESGVFGNHSPLERVSGVVALPEGWNQNACHPLTNFSRPKQADSWLALIERGGCTFTHKINVAAEKGANGVIIYNYQGTGSKVFPMSHQGTENIVAVMISNLKGMEILHSIQKGVYVTVIIEVGRMHMQWVSHYIMYLFTFLAATIAYFYLDCVWRLTPRVPNSFTRRRSQIKTDVKKAIDQLQLRVLKEGDEELDLNEDNCVVCFDTYKPQDVVRILTCKHFFHKACIDPWLLAHRTCPMCKCDILKT

SEQ ID NO: 11495 - protein, 396 aa, Homo Sapiens
MAMSLIQACCSLALSTWLLSFCFVHLLCLDFTVAEKEEWYTAFVNITYAEPAPDPGAGAAGGGGAELHTEKTECGRYGEHSPKQDARGEVVMASSAHDRLACDPNTKFAAPTRGKNWIALIPKGNCTYRDKIRNAFLQNASAVVIFNVGSNTNETITMPHAGVEDIVAIMIPEPKGKEIVSLLERNITVTMYITIGTRNLQKYRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEQEPAVSSDSDISLIMAMEVGLSDVELSTDQDCEEVKS

SEQ ID NO: 11496 - protein, 405 aa, Homo Sapiens
MAMSLIQACCSLALSTWLLSFCFVHLLCLDFTVAEKEEWYTAFVNITYAEPAPDPGAGAAGGGGAELHTEKTECGRYGEHSPKQDARGEVVMASSAHDRLACDPNTKFAAPTRGKNWIALIPKGNCTYRDKIRNAFLQNASAVVIFNVGSNTNETITMPHAGVEDIVAIMIPEPKGKEIVSLLERNITVTMYITIGTRNLQKYVSRTSVVFVSISFIVLMIISLAWLVFYYIQRFRYANARDRNQRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEFCHT

SEQ ID NO: 11497 - protein, 438 aa, Homo Sapiens
MAMSLIQACCSLALSTWLLSFCFVHLLCLDFTVAEKEEWYTAFVNITYAEPAPDPGAGAAGGGGAELHTEKTECGRYGEHSPKQDARGEVVMASSAHDRLACDPNTKFAAPTRGKNWIALIPKGNCTYRDKIRNAFLQNASAVVIFNVGSNTNETITMPHAGVEDIVAIMIPEPKGKEIVSLLERNITVTMYITIGTRNLQKYVSRTSVVFVSISFIVLMIISLAWLVFYYIQRFRYANARDRNQRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEQEPAVSSDSDISLIMAMEVGLSDVELSTDQDCEEVKS

SEQ ID NO: 11498 - protein, 230 aa, Homo Sapiens
MIPEPKGKEIVSLLERNITVTMYITIGTRNLQKYVSRTSVVFVSISFIVLMIISLAWLVFYYIQRFRYANARDRNQRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTN

SEQ ID NO: 11499 - protein, 297 aa, Homo Sapiens
MSSHAQPLKLISPCPYSLSSGVEDIVAIMIPEPKGKEIVSLLERNITVTMYITIGTRNLQKYVSRTSVVFVSISFIVLMIISLAWLVFYYIQRFRYANARDRNQRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEQEPAVSSDSDISLIMAMEVGLSDVELSTDQDCEEVKS

SEQ ID NO: 11500 - protein, 208 aa, Homo Sapiens
HNVNSNELLNMVWNSEEIQQQIWIPSVFIGERSSEYLRALFVYEKGARVLLVPDNTFPLGYYLIPFTGIVGLLVLAMGAVMIARCIQHRKRLQRNRLTKEQLKQIPTHDYQKGDQYDVCAICLDEYEDGDKLRVLPCAHGEALTACPCPSATSSHQVLHLVPLCSLPQPLRGPLAHSDPEDLPHLQAACSSGSWGRRPRGRNSRARGG

SEQ ID NO: 11501 - protein, 72 aa, Homo Sapiens
MDFADLPALFGATLSQEGLQGFLVEAHPDNACSPIAPPPPAPVNGSVFIALLRRFDCNFDLKVLNAQKAGYG

SEQ ID NO: 11502 - protein, 315 aa, Homo Sapiens
MDFADLPALFGATLSQEGLQGFLVEAHPDNACSPIAPPPPAPVNGSVFIALLRRFDCNFDLKVLNAQKAGYGAAVVHNVNSNELLNMVWNSEEIQQQIWIPSVFIGERSSEYLRALFVYEKGARVLLVPDNTFPLGYYLIPFTGIVGLLVLAMGAVMIARCIQHRKRLQRNRLTKEQLKQIPTHDYQKGDQYDVCAICLDEYEDGDKLRVLPCAHAYHSRCVDPWLTQTRKTCPICKQPVHRGPGDEDQEEETQGQEEGDEGEPRDHPASERTPLLGSSPTLPTSFGSLAPAPLVFPGPSTDPPLSPPSSPVILV

SEQ ID NO: 11503 - protein, 133 aa, Homo Sapiens
MHPAAFPLPVVVAAVLWGAAPTRGLIRAGFLVEAHPDNACSPIAPPPPAPVNGSVFIALLRRFDCNFDLKVLNAQKAGYGAAVVHNVNSNELLNMVWNSEEIQQQIWIPSVFIGERSSEYLRALFVYEKGRPV

SEQ ID NO: 11504 - protein, 97 aa, Homo Sapiens
MHPAAFPLPVVVAAVLWGAAPTRGLIRATSDHNASMDFADLPALFGATLSQEGLQGFLVEAHPDNACSPIAPPPPAPVNGSVFIALLRRFDCNFDLK

SEQ ID NO: 11505 - protein, 122 aa, Homo Sapiens
MHPAAFPLPVVVAAVLWGAAPTRGLIRATSDHNASMDFADLPALFGATLSQEGLQGFLVEAHPDNACSPIAPPPPAPVNGSVFIALLRRFDCNFDLKVLNAQKAGYGAAVVHNVNSNELLNM

SEQ ID NO: 11506 - protein, 350 aa, Homo Sapiens [sequence omitted]

SEQ ID NO: 11507 - protein, 350 aa, Homo Sapiens [sequence omitted]

SEQ ID NO: 11508 - protein, 350 aa, Homo Sapiens [sequence omitted]

SEQ ID NO: 11509 - protein, 350 aa, Homo Sapiens [sequence omitted]

SEQ ID NO: 11510 - protein, 74 aa, Homo Sapiens
  misc_feature (1)..(1): Xaa can be any naturally occurring amino acid
XEIQQQIWIPSVFIGERSSEYLRALFVYEKGLPQPLRGPLAHSDPEDLPHLQAACSSGSWGRRPRGRNSRARGG

SEQ ID NO: 11511 - protein, 566 aa, Homo Sapiens
MDLHRAAFKMENSSYLPNPLASPALMVLASTAEASRDASIPCQQPRPFGVPVSVDKDVHIPFTNGSYTFASMYHRQGGVPGTFANRDFPPSLLHLHPQFAPPNLDCTPISMLNHSGVGAFRPFASTEDRESYQSAFTPAKRLKNCHDTESPHLRFSDADGKEYDFGTQLPSSSPGSLKVDDTGKKIFAVSGLISDREASSSPEDRNDRCKKKAAALFDSQAPICPICQVLLRPSELQEHMEQELEQLAQLPSSKNSLLKDAMAPGTPKSLLLSASIKREGESPTASPHSSATDDLHHSDRYQTFLRVRANRQTRLNARIGKMKRRKQDEGQREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 11512 - protein, 566 aa, Homo Sapiens; identical to SEQ ID NO: 11511

SEQ ID NO: 11513 - protein, 566 aa, Homo Sapiens; identical to SEQ ID NO: 11511

SEQ ID NO: 11514 - protein, 259 aa, Homo Sapiens
MPRARSGRRSRGAGGREETFLRVRANRQTRLNARIGKMKRRKQDEGQREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTL

SEQ ID NO: 11515 - protein, 260 aa, Homo Sapiens
MPRARSGRRSRGAGGREETFLRVRANRQTRLNARIGKMKRRKQDEGQVCPLCNRPLAGSEQEMSRHVEHCLSKREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICM

SEQ ID NO: 11516 - protein, 45 aa, Homo Sapiens
MPRARSGRRSRGAGGREEVDLSASTSQPADPTECSDWENETEEAR

SEQ ID NO: 11517 - protein, 121 aa, Homo Sapiens
  misc_feature (1)..(1): Xaa can be any naturally occurring amino acid
XEGESPTASPHSSATDDLHHSDRYQTFLRVRANRQTRLNARIGKMKRRKQDEGQVCPLCNRPLAGSEQEMSRHVEHCLSKREGSCMAEDDAVDIEHENNNRFEEYEWCGQKRIRATTLLEG

SEQ ID NO: 11518 - protein, 372 aa, Homo Sapiens
MKAGATSMWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQTSSFFTRSFFSNYTAPSATMSSFQGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 11519 - protein, 507 aa, Homo Sapiens
MKAGATSMWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQTSSFFTRSFFSNYTAPSATMSSFQGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMRMSSCKGRLRNGPESSAVTIQKDQRKVSAHSSPKRVVEQLLPWKDLQNGIALWSVVPRSKWKIKALIFVKSLPSQSPPRIYILILGLTQFLQEFFFYLPKLDTHRHLGYELLTAFLGDLLAVPQVNMTDVSTAFEEGQALISDLIAVCREEIVM

SEQ ID NO: 11520 - protein, 180 aa, Homo Sapiens
MKGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 11521 - protein, 45 aa, Homo Sapiens
MKMASGCSCRMRKTTACVASAWMPSSTVSYWSVGTWLPAPSAASA

SEQ ID NO: 11522 - protein, 373 aa, Homo Sapiens
MRKAGATSMWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQTSSFFTRSFFSNYTAPSATMSSFQGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 11523 - protein, 38 aa, Homo Sapiens
MWASCCGLLNEVMGTGAVRGQQSAFAGATGPFRFTPNP

SEQ ID NO: 11524 - protein, 74 aa, Homo Sapiens
MWASCCGLLNEVMGTGAVRGQQSAFAGATGPFRFTPNPEFSTYPPAATEGPNIVCKACGLSFSVFRKKHVCCDC

SEQ ID NO: 11525 - protein, 163 aa, Homo Sapiens
MWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQ

SEQ ID NO: 11526 - protein, 175 aa, Homo Sapiens
MAQVLIVGAGMTGSLCAALLRRQTSGPLYLAVWDKAEDSGGRMTTACSPHNPQCTADLGAQYITCTPHYAKKHQRFYDELLAYGVLRPLSSPIEGMVMKEGDCNFVAPQGISSIIKHYLKESGAEVYFRHRVTQINLRDDKWEVSKQTGSPEQFDLIVLTMPVPEILQLQGDITT

SEQ ID NO: 11527 - protein, 342 aa, Homo Sapiens
MAQVLIVGAGMTGSLCAALLRRQTSGPLYLAVWDKAEDSGGRMTTACSPHNPQCTADLGAQYITCTPHYAKKHQRFYDELLAYGVLRPLSSPIEGMVMKEGDCNFVAPQGISSIIKHYLKESGAEVYFRHRVTQINLRDDKWEVSKQTGSPEQFDLIVLTMPVPEILQLQGDITTLISECQRQQLEAVSYSSRYALGLFYEAGTKIDVPWAGQYITSNPCIRFVSIDNKKRNIESSEIGPSLVIHTTVPFGVTYLEHSIEDVQELVFQQLENILPGLPQPIATKCQKWRHSQVTNAAANCPGQMTLHHKPFLACGGDGFTQSNFDGCITSALCVLEALKNYI

SEQ ID NO: 11528 - protein, 315 aa, Homo Sapiens
MAQVLIVGAGMTGSLCAALLRRQTSGPLYLAVWDKAEDSGGRMTTACSPHNPQCTADLGAQYITCTPHYAKKHQRFYDELLAYGVLRPLSSPIEGMVMKEGDCNFVAPQGISSIIKHYLKESGAEVYFRHRVTQINLRDDKWEVSKQTGSPEQFDLIVLTMPVPEILQLQGDITTLISECQRQQLEAVSYSSRYALGLFYEAGTKIDVPWAGQYITSNPCIRFVSIDNKKRNIESSEIGPSLVIHTTVPFGVTYLEHSIEDVQELVFQQLENILPGLPQPIATKCQKWRHSQVPSAGVILGCAKSPWMMAIGFPI

SEQ ID NO: 11529 - protein, 171 aa, Homo Sapiens
FRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEEPGVG

SEQ ID NO: 11530 - protein, 168 aa, Homo Sapiens
LIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGVDPDDTYNETPYEKGFCFVSYLAHLVGDQDQFDSFLKAYVHEFKFRSILADDFLDFYL

SEQ ID NO: 11531 - protein, 650 aa, Homo Sapiens
MASGEHSPGSGAARRPLHSAQAVDVASASNFRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 11532 - protein, 611 aa, Homo Sapiens
MASGEHSPGSGAARRPLHSAQAVDVASASNFRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 11533 - protein, 344 aa, Homo Sapiens
MTCCSCTSLSALLDFWAEVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIP

SEQ ID NO: 11534 - protein, 151 aa, Homo Sapiens
  misc_feature (1)..(1): Xaa can be any naturally occurring amino acid
XPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEEPGVG

SEQ ID NO: 11535 - protein, 937 aa, Homo Sapiens
MHRPRRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACDSKDSKEKNKMEILYILVPSVAIPLAIALLFFFICVCRNNQKSSSAPVQRQPKHVRGQNVEMSMLNAYKPKSKAKELPLSAVRFMEELGECAFGKIYKGHLYLPGMDHAQLVAIKTLKDYNNPQQWTEFQQEASLMAELHHPNIVCLLGAVTQEQPVCMLFEYINQGDLHEFLIMRSPHSDVGCSSDEDGTVKSSLDHGDFLHIAIQIAAGMEYLSSHFFVHKDLAARNILIGEQLHVKISDLGLSREIYSADYYRVQSKSLLPIRWMPPEAIMYGKFSSDSDIWSFGVVLWEIFSFGLQPYYGFSNQEVIEMVRKRQLLPCSEDCPPRMYSLMTECWNEIPSRRPRFKDIHVRLRSWEGLSSHTSSTTPSGGNATTQTTSLSASPVSNLSNPRYPNYMFPSQGITPQGQIAGFIGPPIPQNQRFIPINGYPIPPGYAAFPAAHYQPTGPPRVIQHCPPPKSRSPSSASGSTSTGHVTSLPSSGSNQEANIPLLPHMSIPNHPGGMGITVFGNKSQKPYKIDSKQASLLGDANIHGHTESMISAEL

SEQ ID NO: 11536 - protein, 393 aa, Homo Sapiens
MHRPRRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACGK

SEQ ID NO: 11537 - protein, 882 aa, Homo Sapiens
SYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACDSKDSKEKNKMEILYILVPSVAIPLAIALLFFFICVCRNNQKSSSAPVQRQPKHVRGQNVEMSMLNAYKPKSKAKELPLSAVRFMEELGECAFGKIYKGHLYLPGMDHAQLVAIKTLKDYNNPQQWTEFQQEASLMAELHHPNIVCLLGAVTQEQPVCMLFEYINQGDLHEFLIMRSPHSDVGCSSDEDGTVKSSLDHGDFLHIAIQIAAGMEYLSSHFFVHKDLAARNILIGEQLHVKISDLGLSREIYSADYYRVQSKSLLPIRWMPPEAIMYGKFSSDSDIWSFGVVLWEIFSFGLQPYYGFSNQEVIEMVRKRQLLPCSEDCPPRMYSLMTECWNEIPSRRPRFKDIHVRLRSWEGLSSHTSSTTPSGGNATTQTTSLSASPVSNLSNPRYPNYMFPSQGITPQGQIAGFIGPPIPQNQRFIPINGYPIPPGYAAFPAAHYQPTGPPRVIQHCPPPKSRSPSSASGSTSTGHVTSLPSSGSNQEANIPLLPHMSIPNHPGGMGITVFGNKSQKPYKIDSKQASLLGDANIHGHTESMISAEL

SEQ ID NO: 11538 - protein, 180 aa, Homo Sapiens
MSHRKFSAPRHGSLGFLPRKRSSRHRGKVKSFPKDDPSKPVHLTAFLGYKAGMTHIVREVDRPGSKVNKKEVVEAVTIVETPPMVVVGIVGYVETPRGLRTFKTVFAEHISDECKRRFYKNCSARLCPMSSIQAPLAGGKGSLEAGNELHPHAVPVCLPLTPRRGDEGLHLVPSPTLLCS

SEQ ID NO: 11539 - protein, 403 aa, Homo Sapiens
MSHRKFSAPRHGSLGFLPRKRSSRHRGKVKSFPKDDPSKPVHLTAFLGYKAGMTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPARVAFSVARAGQKGYHHRTEINKKIYKIGQGYLIKDGKLIKNNASTDYDLSDKSINPLGGFVHYGEVTNDFVMLKGCVVGTKKRVLTLRKSLLVQTKRRALEKIDLKFIDTTSKFGHGRFQTMEEKKAFMGPLKKDRIAKEEGA

SEQ ID NO: 11540 - protein, 351 aa, Homo Sapiens
MTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPARVAFSVARAGQKGYHHRTEINKKIYKIGQGYLIKDGKLIKNNASTDYDLSDKSINPLGGFVHYGEVTNDFVMLKGCVVGTKKRVLTLRKSLLVQTKRRALEKIDLKFIDTTSKFGHGRFQTMEEKKAFMGPLKKDRIAKEEGA

SEQ ID NO: 11541 - protein, 272 aa, Homo Sapiens
MTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPARVAFSVARAGQKGYHHRTEINKKIYKIGQGYLIKDGKLIKNNASTDYDLSDKSINPLGGFVHYG

SEQ ID NO: 11542 - protein, 305 aa, Homo Sapiens
QMMNLLTGGQKLCADCHVLIWLCGVLWPSHRKFSAPRHGSLGFLPRKRSSRHRGKVKSFPKDDPSKPVHLTAFLGYKAGMTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPARVAFSVARAGQKGYHHRT

SEQ ID NO: 11543 - protein, 261 aa, Homo Sapiens
  misc_feature (1)..(1): Xaa can be any naturally occurring amino acid
XVCVVMAAVSLSPASARLNPRRIAAIPSWPAPGSHRKFSAPRHGSLGFLPRKRSSRHRGKVKSFPKDDPSKPVHLTAFLGYKAGMTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYK

SEQ ID NO: 11544 - protein, 115 aa, Homo Sapiens
MRYVASYLLAALGGNSSPSAKDIKKILDSVGIEADDDRLNKVISELNGKNIEDVIAQGIGKLASVPAGGAVAVSAAPGSAAPAAGSAPAAAEEKKDEKKEESEESDDDMGFGLFD

SEQ ID NO: 11545 - protein, 115 aa, Homo Sapiens; identical to SEQ ID NO: 11544

SEQ ID NO: 11546 - protein, 92 aa, Homo Sapiens
  misc_feature (1)..(1): Xaa can be any naturally occurring amino acid
XGGNSSPSAKDIKKILDSVISELNGKNIEDVIAQGIGKLASVPAGGAVAVSAAPGSAAPAAGSAPAAAEEKKDEKKEESEESDDDMGFGLFD

SEQ ID NO: 11547 - protein, 138 aa, Homo Sapiens
ELDTSERKIEFDSASGTYTLYLIIGDATLKNPILWNVADVVIKFPEEEAPSTVLSQNLFTPKQEIQWIRIGANVSNFTFAPSTIIFHLGHAAMLGLMYVYWTQLNMFQTLKYLAILGSVTFLAGNRMLAQQAVKRTAH

SEQ ID NO: 11548 - protein, 615 aa, Homo Sapiens
MAPPGSSTVFLLALTIIASTWALTPTHYLTKHDVERLKASLDRPFTNLESAFYSIVGLSSLGAQVPDAKISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAAMLGLMYVYWTQLNMFQTLKYLAILGSVTFLAGNRMLAQQAVKRIAAEQSSRLAKYRTLRTAH

SEQ ID NO: 11549 - protein, 345 aa, Homo Sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLARVWSTVLESRSLFSKRTVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVG

SEQ ID NO: 11550 - protein, 631 aa, Homo Sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAAMLGLMYVYWTQLNMFQTLKYLAILGSVTFLAGNRMLAQQAVKRTAH

SEQ ID NO: 11551 - protein, 162 aa, Homo Sapiens
MQRKHVPTSDLTLIPAMWIPSSTLPRPARPSQDVRTVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAI

SEQ ID NO: 11552 - protein, 167 aa, Homo Sapiens
MQRTVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTS

SEQ ID NO: 11553 - protein, 147 aa, Homo Sapiens
  misc_feature (1)..(1): Xaa can be any naturally occurring amino acid
XGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAEQHISSRRKMEILKTECQEKESRTIHSMRRKMEKKNFI

SEQ ID NO: 11554 - protein, 100 aa, Homo Sapiens
MCQRCGLKLIVIICFFVQLARDLLHPSLEEEKKKHKKKRLVQSPNSYFMDVKCPGCYKITTVFSHAQTVVLCVGCSTVLCQPTGGKARLTEGCSFRRKQH

SEQ ID NO: 11555 - protein, 52 aa, Homo Sapiens
MDVKCPGCYKITTVFSHAQTVVLCVGCSTVLCQPTGGKARLTEGCSFRRKQH

SEQ ID NO: 11556 - protein, 52 aa, Homo Sapiens; identical to SEQ ID NO: 11555

SEQ ID NO: 11557 - protein, 52 aa, Homo Sapiens; identical to SEQ ID NO: 11555

SEQ ID NO: 11558 - protein, 84 aa, Homo Sapiens
MPLARDLLHPSLEEEKKKHKKKRLVQSPNSYFMDVKCPGCYKITTVFSHAQTVVLCVGCSTVLCQPTGGKARLTEGCSFRRKQH

SEQ ID NO: 11559 - protein, 97 aa, Homo Sapiens
MPLARDLLHPSLEEEKKKHKKKRLVQSPNSYFMDVKCPGCYKITTVFSHAQTVVLCVGCSTVLCQPTGGKARLTEGISFGILQPSDEIDDYKCLYLH

SEQ ID NO: 11560 - protein, 224 aa, Homo Sapiens
MSRKIEGFLLLLLFGYEATLGLSSTEDEGEDPWYQKACKCDCQGGPNALWSAGATSLDCIPECPYHKPLGFESGEVTPDQITCSNPEQYVGWYSSWTANKARLNSQGFGCAWLSKFQDSSQWLQIDLKEIKVISGILTQGRCDIDEWMTKYSVQYRTDERLNWIYYKDQTGNNRVFYGNSDRTSTVQNLLRPPIISRFIRLIPLGWHVRIAIRMELLECVSKCA

SEQ ID NO: 11561 - protein, 702 aa, Homo Sapiens
ATAAAAAAVMAPPGCPGSCPNFAVVCSFLERYGPLLDLPELPFPELERVLQAPPPDVGNGEVPKELVELHLKLMRKIGKSVTADRWEKYLIKICQEFNSTWAWEMEKKGYLEMSVECKLALLKYLCECQFDDNLKFKNIINEEDADTMRLQPIGRDKDGLMYWYQLDQDHNVRMYIEEQDDQDGSSWKCIVRNRNELAETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQK

SEQ ID NO: 11562 - protein, 276 aa, Homo Sapiens
EPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTP

SEQ ID NO: 11563 - protein, 803 aa, Homo Sapiens
ETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKK

SEQ ID NO: 11564 - protein, 1441 aa, Homo Sapiens
MATAAAAAAVMAPPGCPGSCPNFAVVCSFLERYGPLLDLPELPFPELERVLQAPPPDVGNGEVPKELVELHLKLMRKIGKSVTADRWEKYLIKICQEFNSTWAWEMEKKGYLEMSVECKLALLKYLCECQFDDNLKFKNIINEEDADTMRLQPIGRDKDGLMYWYQLDQDHNVRMYIEEQDDQDGSSWKCIVRNRNELAETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 11565 - protein, 1189 aa, Homo Sapiens
MKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 11566 - protein, 202 aa, Homo Sapiens
  misc_feature (1)..(1): Xaa can be any naturally occurring amino acid
XAAAAAAVMAPPGCPGSCPNFAVVCSFLERYGPLLDLPELPFPELERVLQAPPPDVGNGEVPKELVELHLKLMRKIGKSVTADRWEKYLIKYLCECQFDDNLKFKNIINEEDADTMRLQPIGRDKDGLMYWYQLDQDHNVRMYIEEQDDQDGSSWKCIVRNRNELAETLALLKAQIDPVLLKNSSQQDNSSRESPSLEDEET

SEQ ID NO: 11567 - protein, 165 aa, Homo Sapiens
  misc_feature (1)..(1): Xaa can be any naturally occurring amino acid
XKPDSPPKVLEPENKQEKTEKEEEKTNVGRTLRRSPRISRPTAKVAEIRDQKADKKRGEGEDEVEEESTALQKTDKKEILKKSEKDTNSKVKPKGKVRWTGSRTRGRWKYSSNDESEGSGSEKSSAASEEEEEKESEEAILADDDEPCKKCGLPNHPELILLCDS

SEQ ID NO: 11568 - protein, 236 aa, Homo Sapiens
MIFRVSAEGSQACAKGCELCSEVNGCLKCSPKLFILLERNDIRQVGVCLPSCPPGYFDARNPDMNKCIKCKIEHCEACFSHNFCTKCKEGLYLHKGRCYPACPEGSSAANGTMECSSPAQCEMSEWSPWGPCSKKQQLCGFRRGSEERTRRVLHAPVGDHAACSDTKETRRCTVRRVPCPEGQKRRKGGQGRRENANRNLARKESKEAGAGSRRRKGQQQQQQQGTVGPLTSAGPA

SEQ ID NO: 11569 - protein, 263 aa, Homo Sapiens
MRLGLCVVALVLSWTHLTISSRGIKGKRQRRISAEGSQACAKGCELCSEVNGCLKCSPKLFILLERNDIRQVGVCLPSCPPGYFDARNPDMNKCIKCKIEHCEACFSHNFCTKCKEGLYLHKGRCYPACPEGSSAANGTMECSSPAQCEMSEWSPWGPCSKKQQLCGFRRGSEERTRRVLHAPVGDHAACSDTKETRRCTVRRVPCPEGQKRRKGGQGRRENANRNLARKESKEAGAGSRRRKGQQQQQQQGTVGPLTSAGPA

SEQ ID NO: 11570 - protein, 263 aa, Homo Sapiens; identical to SEQ ID NO: 11569

SEQ ID NO: 11571 - protein, 200 aa, Homo Sapiens
MRLGLCVVALVLSWTHLTISSRGIKGKRQRRISAEGSQACAKGCELCSEVNGCLKCSPKLFILLERNDIRQVGVCLPSCPPGYFDARNPDMNKCIKCKIEHCEACFSHNFCTKCKEGLYLHKGRCYPACPEGSSAANGTMECSSPGQKRRKGGQGRRENANRNLARKESKEAGAGSRRRKGQQQQQQQGTVGPLTSAGPA

SEQ ID NO: 11572 - protein, 89 aa, Homo Sapiens
MDLASYVSNPICKGCLSCSKDNGCSRCQQKLFFFLRREGMRQYGECLHSCPSGYYGHRAPDMNRCARCRIENCDSCFSKDFCTKCKVGF

SEQ ID NO: 11573 - protein, 77 aa, Homo Sapiens
MQFRLFSFALIILNCMDYSHCQGNRWRRSKRASYVSNPICKGCLSCSKDNGCSRCQQKLFFFLRREGMRQYGECLHS

SEQ ID NO: 11574 - protein, 121 aa, Homo Sapiens
MQFRLFSFALIILNCMDYSHCQGNRWRRSKRASYVSNPICKGCLSCSKDNGCSRCQQKLFFFLRREGMRQYGECLHSCPSGYYGHRAPDMNRCARCRIENCDSCFSKDFCTKCKVGFYLHR

SEQ ID NO: 11575 - protein, 243 aa, Homo Sapiens
MQFRLFSFALIILNCMDYSHCQGNRWRRSKRASYVSNPICKGCLSCSKDNGCSRCQQKLFFFLRREGMRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTILCPTIAESRRCKMTMRHCPGGKRTPKAKEKRNKKKKRKLIERAQEQHSVFLATDRANQ

SEQ ID NO: 11576 - protein, 179 aa, Homo Sapiens
MQFRLFSFALIILNCMDYSHCQGNRWRRSKRGCRIENCDSCFSKDFCTKCKVGFYLHRGRCFDECPDGFAPLEETMECVGCEVGHWSEWGTCSRNNRTCGFKWGLETRTRQIVKKPVKDTILCPTIAESRRCKMTMRHCPGGKRTPKAKEKRNKKKKRKLIERAQEQHSVFLATDRANQ

SEQ ID NO: 11577 - protein, 89 aa, Homo Sapiens
MRQYGECLHSCPSGYYGHRAPDMNRCARCRIENCDSCFSKDFCTKCKVGFYLHRGRCFDECPDGFAPLEETMECVEGCEVGHWSEWGTC

SEQ ID NO: 11578 - protein, 168 aa, Homo Sapiens
MRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTILCPTIAESRRCKMTMRHCPGGKRTPKAKEKRNKKKKRKLIERAQEQHSVF

SEQ ID NO: 11579 - protein, 176 aa, Homo Sapiens
MRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTILCPTIAESRRCKMTMRHCPGGKRTPKAKEKRNKKKKRKLIERAQEQHSVFLATDRANQ

SEQ ID NO: 11580 - protein, 272 aa, Homo Sapiens
MHLRLISWLFIILNFMEYIGSQNASRGRRQRRMHPNVSQGCQGGCATCSDYNGCLSCKPRLFFALERIGMKQIGVCLSSCPSGYYGTRYPDINKCTKCKADCDTCFNKNFCTKCKSGFYLHLGKCLDNCPEGLEANNHTMECVSIVHCEVSEWNPWSPCTKKGKTCGFKRGTETRVREIIQHPSAKGNLCPPTNETRKCTVQRKKCQKGERGKKGRERKRKKPNKGESKEAIPDSKSLESSKEIPEQRENKQQQKKRKVQDKQKSVSVSTVH

SEQ ID NO: 11581 - protein, 292 aa, Homo Sapiens
MHLRLISWLFIILNFMEYIGSQNASRGRRQRRMHPNVSQGCQGGCATCSDYNGCLSCKPRLFFALERIGMKQIGVCLSSCPSGYYGTRYPDINKCTKCKADCDTCFNKNFCTKCKSGFYLHLGKCLDNCPEGLEANNHTMECVSIVHCEVSEWNPWSPCTKKGKTCGFKRGTETRVREIIQHPSAKGNLCPPTNETRKCTVQRKKCQKGERGKKGRERKRKKPNKGESKEAIPDSKSLESSKEIPEQRENKQQQKKRKVQDKQKSGIEVTLAEGLTSVSQRTQPTPCRRRYL

SEQ ID NO: 11582 - protein, 172 aa, Homo Sapiens
MRAPLCLLLLVAHAVDMLALNRRKKQVGTGLGGNCTGCIICSEENGCSTCQQRLFLFIRREGIRQYGKCLHDCPPGYFGIRGQEVNRCKKCGATCESCFSQDFCIRCKRQFYLYKGKCLPTCPPGTLAHQNTRECQERSPGQKKGRKDRRPRKDRKLDRRLDVRPRQPGLQP

SEQ ID NO: 11583 - protein, 234 aa, Homo Sapiens
MRAPLCLLLLVAHAVDMLALNRRKKQVGTGLGGNCTGCIICSEENGCSTCQQRLFLFIRREGIRQYGKCLHDCPPGYFGIRGQEVNRCKKCGATCESCFSQDFCIRCKRQFYLYKGKCLPTCPPGTLAHQNTRECQGECELGPWGGWSPCTHNGKTCGSAWGLESRVREAGRAGHEEAATCQVLSESRKCPIQRPCPGERSPGQKKGRKDRRPRKDRKLDRRLDVRPRQPGLQP

SEQ ID NO: 11584 - protein, 45 aa, Homo Sapiens
MITLHEMAETDEGWLDVVQSLIRVIPLEDPLGPAVITLLLDECPL

SEQ ID NO: 11585 - protein, 172 aa, Homo Sapiens
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDKRKLQNEDAYIGPCFHKSSTGIVVSLPGISLSDQEPPYSMITLHEMAETDEGWLDV

SEQ ID NO: 11586 - protein, 121 aa, Homo Sapiens
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDNDQEP

SEQ ID NO: 11587 - protein, 146 aa, Homo Sapiens
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDNDQEPPYSMITLHEMAETDEGWLDVVQSLI

SEQ ID NO: 11588 - protein, 146 aa, Homo Sapiens; identical to SEQ ID NO: 11587

SEQ ID NO: 11589 - protein, 576 aa, Homo Sapiens
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDNDQEPPYSMITLHEMAETDEGWLDVVQSLIRVIPLEDPLGPAVITLLLDECPLPTKDALQKLTEILNLNGEVACQDSSHPAKHRNTSAVLGCLAEKLAGPASIGLLSPGILEYLLQCLKLQSHPTVMLFALIALEKFAQTSENKLTISESSISDRLVTLESWANDPDYLKRQVGFCAQWSLDNLFLKEGRQLTYEKVNLSSIRAMLNSNDVSEYLKISPHGLEARCDASSFESVRCTFCVDAGVWYYEVTVVTSGVMQIGWATRDSKFLNHEGYGIGDDEYSCAYDGCRQLIWYNARSKPHIHPCWKEGDTVGFLLDLNEKQMIFFLNGNQLPPEKQVFSSTVSGFFAAASFMSYQQCEFNFGAKPFKYPPSMKFSTFNDYAFLTAEEKIILPRHRRLALLKQVSIRENCCSLCCDEVADTQLKPCGHSDLCMDCALQLETCPLCRKEIVSRIRQISHIS

SEQ ID NO: 11590 - protein, 576 aa, Homo Sapiens; identical to SEQ ID NO: 11589

SEQ ID NO: 11591 - protein, 239 aa, Homo Sapiens
MARQLLSQVDMDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSILDAAGSGSGSGSGSGP

SEQ ID NO: 11592 - protein, 191 aa, Homo Sapiens
MARQVDMDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNIS

SEQ ID NO: 11593 - protein, 70 aa, Homo Sapiens
MDCRVHMRPIGLTWVLQLTLAWILLEACGGSRPLQARSQQHHGLAADLGKGKLHLAEMDTTETSGPGNHP

SEQ ID NO: 11594 - protein, 193 aa, Homo Sapiens
MDCRVHMRPIGLTWVLQLTLAWILLEACGGSRPLQARSQQHHGLAADLGKGKLHLAEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGR

SEQ ID NO: 11595 - protein, 174 aa, Homo Sapiens
MDCRVHMRPIGLTWVLQLTLAWILLEACGGSRPLQARSQQHHGLAADLGKGKLHLAGDPQASVPKPYLNIQDPSSQGSPLPGPCCPSEMDTTETSGPGNHPERCGVPSPECESFLEHLQRALRSRFRLRLLGVRQAQPLCEELCQAWFANCEDDITCGPTWLPLSEKRGCEPSC

SEQ ID NO: 11596 - protein, 130 aa, Homo Sapiens
MDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDI

SEQ ID NO: 11597 - protein, 186 aa, Homo Sapiens
MDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISI

SEQ ID NO: 11598 - protein, 214 aa, Homo Sapiens
MDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSIL

SEQ ID NO: 11599 - protein, 229 aa, Homo Sapiens
MDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSILDAAGSGSGSGSGSGP

SEQ ID NO: 11600 - protein, 229 aa, Homo Sapiens; identical to SEQ ID NO: 11599

SEQ ID NO: 11601 - protein, 114 aa, Homo Sapiens [sequence omitted]

SEQ ID NO: 11602 - protein, 205 aa, Homo Sapiens
MDEALETQLKTSRGRFSATESLPTLELLSQVDMDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQAGVQWRDLSSMQPPPPGFK

SEQ ID NO: 11603 - protein, 261 aa, Homo Sapiens
MDEALETQLKTSRGRFSATESLPTLELLSQVDMDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSILDAAGSGSGSGSGSGP

SEQ ID NO: 11604 - protein, 441 aa, Homo Sapiens
MLRKGCCVELLLLLVAAELPLGGGCPRDCVCYPAPMTVSCQAHNFAAIPEGIPVDSERVFLQNNRIGLLQPGHFSPAMVTLWIYSNNITYIHPSTFEGFVHLEELDLGDNRQLRTLAPETFQGLVKLHALYLYKCGLSALPAGVFGGLHSLQYLYLQDNHIEYLQDDIFVDLVNLSHLFLHGNKLWSLGPGTFRGLVNLDRLLLHENQLQWVHHKAFHDLRRLTTLFLFNNSLSELQGECLAPLGALEFLRLNGNPWDCGCRARSLWEWLQRFRGSSSAVPCVSPGLRHGQDLKLLRAEDFRNCTGPASPHQIKSHTLTTTDRAARKEHHSPHGPTRSKGHPHGPRPGHRKPGKNCTNPRNRNQISKAGAGKQAPELPDYAPDYQHKFSFDIMPTARPKRKGKCARRTPIRAPSGVQQASSASSLGASLLAWTLGLAVTLR

SEQ ID NO: 11605 - protein, 420 aa, Homo Sapiens
MLPGLRRLLQAPASACLLLMLLALPLAAPSCPMLCTCYSSPPTVSCQANNFSSVPLSLPPSTQRLFLQNNLIRTLRPGTFGSNLLTLWLFSNNLSTIYPGTFRHLQALEELDLGDNRHLRSLEPDTFQGLERLQSLHLYRCQLSSLPGNIFRGLVSLQYLYLQENSLLHLQDDLFADLANLSHLFLHGNRLRLLTEHVFRGLGSLDRLLLHGNRLQGVHRAAFRGLSRLTILYLFNNSLASLPGEALADLPSLEFLRLNANPWACDCRARPLWAWFQRARVSSSDVTCATPPERQGRDLRALREADFQACPPAAPTRPGSRARGNSSSNHLYGVAEAGAPPADPSTLYRDLPAEDSRGRQGGDAPTEDDYWGGYGGEDQRGEQMCPGAACQAPPDSRGPALSAGLPSPLLCLLLLVPHHL

SEQ ID NO: 11606 - protein, 204 aa, Homo Sapiens
MLPGLRRLLQAPASACLLLMLLALPLAAPSCPMLCTCYSSPPTVSCQANNFSSVPLSLPPSTQRLFLQNNLIRTLRPGTFGSNLLTLWLFSNNLSTIYPGTFRHLQALEELDLGDNRHLRSLEPDTFQGLERLQSLHLYRCQLSSLPGNIFRGLVSLQYLYLQENSLLHLQGKKEKGKSLLCSWRMDALKMEGIPVIVIHCYYY

SEQ ID NO: 11607 - protein, 193 aa, Homo Sapiens
MLPGLRRLLQAPASACLLLMLLALPLAAPSCPMLCTCYSSPPTVSCQANNFSSVPLSLPPSTQRLFLQNNLIRTLRPGTFGSNLLTLWLFSNNLSTIYPGTFRHLQALEELDLGDNRHLRSLEPDTFQGLERLQSLHLYRCQLSSLPGNIFRGLVSLQYLYLQENSLLHLQGPLPKGLCSCFSHPPSSLPTSR

SEQ ID NO: 11608 - protein, 122 aa, Homo Sapiens
MKLLTGLVFCSLVLGVSSRSFFSFLGEAFDGARDMWRAYSDMREANYIGSDKYFHARGNYDAAKRGPGGAWAAEVITDARENIQRFFGHGAEDSLADQAANEWGRSGKDPNHFRPAGLPEKY

SEQ ID NO: 11609 - protein, 122 aa, Homo Sapiens; identical to SEQ ID NO: 11608

SEQ ID NO: 11610 - protein, 122 aa, Homo Sapiens; identical to SEQ ID NO: 11608

SEQ ID NO: 11611 - protein, 80 aa, Homo Sapiens
MKLLTGLVFCSLVLSVSSRSFFSFLGEAFDGARDMWRAYSDMREANYIGSDKYFHARGNYDAAKRGPGGAWAAEVIREDD

SEQ ID NO: 11612 - protein, 113 aa, Homo Sapiens
MKLLTGLVFCSLVLSVSSRSFFSFLGEAFDGARDMWRAYSDMREANYIGSDKYFHARGNYDAAKRGPGGAWAAEVIRLKCHGMIMAHCNLDLPGLKRSSHFSLLNNWDCRCAP

SEQ ID NO: 11613 - protein, 83 aa, Homo Sapiens
MKLLTGLVFCSLVLSVSSRSFFSFLGEAFDGARDMWRAYSDMREANYIGSDKYFHARGNYDAAKRGPGGAWAAEVISLFSAEL

SEQ ID NO: 11614 - protein, 122 aa, Homo Sapiens
MKLLTGLVFCSLVLSVSSRSFFSFLGEAFDGARDMWRAYSDMREANYIGSDKYFHARGNYDAAKRGPGGAWAAEVISNARENIQRLTGRGAEDSLADQAANKWGRSGRDPNHFRPAGLPEKY

SEQ ID NO: 11615 - protein, 122 aa, Homo Sapiens; identical to SEQ ID NO: 11614

SEQ ID NO: 11616 - protein, 122 aa, Homo Sapiens; identical to SEQ ID NO: 11614

SEQ ID NO: 11617 - protein, 130 aa, Homo Sapiens
MRLFTGIVFCSLVMGVTSESWRSFFKEALQGVGDMGRAYWDIMISNHQNSNRYLYARGNYDAAQRGPGGVWAAKLISRSRVYLQGLIDCYLFGNSSTVLEDSKSNEKAEEWGRSGKDPDRFRPDGLPKKY

SEQ ID NO: 11618 - protein, 220 aa, Homo Sapiens
MNGFTPDEMSRGGDAAAAVAAVVAAAAAAASAGNGTGAGTGAEVPGAGAVSAAGPPGAAGPGPGQLCCLREDGERCGRAAGNASFSKRIQKSISQKKVKIELDKSARHLYICDYHKNLIQSVRNRRKRKGSDDDGGDSPVQDIDTPEVDLYQLQVNTLRRYKRHFKLPTRPGLNKAQLVEIVGCHFRSIPVNEKDTLTYFIYSVKNDKNKSDLKVDSGVH

SEQ ID NO: 11619 - protein, 51 aa, Homo Sapiens
MSFIFEWIYNGFSSVLQFLGLYKKSGKLVFLGLDNAGKTTLLHMLKDDRLG

SEQ ID NO: 11620 - protein, 198 aa, Homo Sapiens
MSFIFEWIYNGFSSVLQFLGLYKKSGKLVFLGLDNAGKTTLLHMLKDDRLGQHVPTLHPTSEELTIAGMTFTTFDLGGHEQARRVWKNYLPAINGIVFLVDCADHSRLVESKVELNALMTDETISNVPILILGNKIDRTDAISEEKLREIFGLYGQTTGKGNVTLKELNARPMEVFMCSVLKRQGYGEGFRWLSQYID

SEQ ID NO: 11621 - protein, 198 aa, Homo Sapiens; identical to SEQ ID NO: 11620

SEQ ID NO: 11622 - protein, 198 aa, Homo Sapiens; identical to SEQ ID NO: 11620

SEQ ID NO: 11623 - protein, 198 aa, Homo Sapiens; identical to SEQ ID NO: 11620

SEQ ID NO: 11624 - protein, 121 aa, Homo Sapiens
MSFIFEWIYNGFSSVLQFLGLYKKSGKLVFLGLDNAGKTTLLHMLKDDRLGQHVPTLHPTSEELTIAGMTFTTFDLGGHEQARRVWKNYLPAINGIVFLVDCADHSRLVESKVELNVCFVL

SEQ ID NO: 11625 - protein, 115 aa, Homo Sapiens
  misc_feature (1)..(1): Xaa can be any naturally occurring amino acid
XSFWWTVQIILASWNPKLSLMIYCSSLLTLAPNALMTDETISNVPILILGNKIDRTDAISEEKLREIFGLYGQTTGKGNVTLKELNARPMEVFMCSVLKRQGYGEGFRWLSQYID

SEQ ID NO: 11626 - protein, 213 aa, Homo Sapiens
IAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAYSPLHGGSGSYSVCSNSDTKTRTASGYGGTRRR

SEQ ID NO: 11627 - protein, 36 aa, Homo Sapiens
MAAACGPGAAGYCLLLGLHLFLLTAGPALGWIPSHS

SEQ ID NO: 11628 - protein, 147 aa, Homo Sapiens
MAAACGPGAAGYCLLLGLHLFLLTAGPALGWNDPALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFA

SEQ ID NO: 11629 - protein, 339 aa, Homo Sapiens
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 11630 - protein, 40 aa, Homo Sapiens
MAAACGPGAAGYCLLLGLHLFLLTAGPALGWNDPECCCGM

SEQ ID NO: 11631 - protein, 37 aa, Homo Sapiens
MAAACGPGAAGYCLLLGLHLFLLTAGPALGWNDPVGM

SEQ ID NO: 11632 - protein, 37 aa, Homo Sapiens; identical to SEQ ID NO: 11631

SEQ ID NO: 11633 - protein, 202 aa, Homo Sapiens
MLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNT

SEQ ID NO: 11634 - protein, 167 aa, Homo Sapiens
MSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 11635 - protein, 347 aa, Homo Sapiens
  misc_feature (1)..(1): Xaa can be any naturally occurring amino acid
XAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSDMVVPGDDKVESWSQTLDAEILDFSSLSL

SEQ ID NO: 11636 - protein, 218 aa, Homo Sapiens
  misc_feature (1)..(1): Xaa can be any naturally occurring amino acid
XLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGKSKKYKFLLPRSKVQK

SEQ ID NO: 11637 - protein, 724 aa, Homo Sapiens
MVLTLLLSAYKLCRFFAMSGPRPGAERLAVPGPDGGGGTGPWWAAGGRGPREVSPGAGTEVQDALERALPELQQALSALKQAGGARAVGAGLAEVFQLVEEAWLLPAVGREVAQGLCDAIRLDGGLDLLLRLLQAPELETRVQAARLLEQILVAENRDRVARIGLGVILNLAKEREPVELARSVAGILEHMFKHSEETCQRLVAAGGLDAVLYWCRRTDPALLRHCALALGNCALHGGQAVQRRMVEKRAAEWLFPLAFSKEDELLRLHACLAVAVLATNKEVEREVERSGTLALVEPLVASLDPGRFARCLVDASDTSQGRGPDDLQRLVPLLDSNRLEAQCIGAFYLCAEAAIKSLQGKTKVFSDIGAIQSLKRLVSYSTNGTKSALAKRALRLLGEEVPRPILPSVPSWKEAEVQTWLQQIGFSKYCESFREQQVDGDLLLRLTEEELQTDLGMKSGITRKRFFRELTELKTFANYSTCDRSNLADWLGSLDPRFRQYTYGLVSCGLDRSLLHRVSEQQLLEDCGIHLGVHRARILTAAREMLHSPLPCTGGKPSGDTPDVFISYRRNSGSQLASLLKVHLQLHGFSVFIDVEKLEAGKFEDKLIQSVMGARNFVLVLSPGALDKCMQDHDCKDWVHKEIVTALSCGKNIVPIIDGFEWPEPQVLPEDMQAVLTFNGIKWSHEYQEATIEKIIRFLQGRSSRDSSAGSDTSLEGAAPMGPT

SEQ ID NO: 11638 - protein, 107 aa, Homo Sapiens
  misc_feature (1)..(1): Xaa can be any naturally occurring amino acid
XASLLKVHLQLHGFSVFIDVEKLEAGKFEDKLIQSVMGARNFVLVLSPGALDKCMQDHDCKDWVHKEIVTALSCGKNIVPIIDGFEWPEPQVLPEDMQAVLTFNGIK

SEQ ID NO: 11639 - protein, 118 aa, Homo Sapiens
  misc_feature (1)..(1): Xaa can be any naturally occurring amino acid
XLLPQEQQVDGDLLLRLTEEELQTDLGMKSGITRKRFFRELTELKTFANYSTCDRSNLADWLGSLDPRFRQYTYGLVSCGLDRSLLHRVSEQQLLEDCGIHLGVHRARILTAARAITD

SEQ ID NO: 11640 - protein, 257 aa, Homo Sapiens
  misc_feature (1)..(1): Xaa can be any naturally occurring amino acid
XNLADWLGSLDPRFRQYTYGLVSCGLDRSLLHRVSEQQLLEDCGIHLGVHRARILTAARVSDAEGPPSPCCLLPTSEMLHSPLPCTGGKPSGDTPDVFISYRRNSGSQLASLLKVHLQLHGFSVFIDVEKLEAGKFEDKLIQSVMGARNFVLVLSPGALDKCMQDHDCKDWVHKEIVTALSCGKNIVPIIDGFEWPEPQVLPEDMQAVLTFNGIKWSHEYQEATIEKIIRFLQGRSSRDSSAGSDTSLEGAAPMGPT

SEQ ID NO: 11641 - protein, 8 aa, Homo Sapiens
MDHLNEAT

SEQ ID NO: 11642 - protein, 82 aa, Homo Sapiens
MDHLNEATQGKEHSEMSNNVSDPKGPPAKIARLEQNGSPLGRGRLGSTGAKMQGVPLKHSGHLMKTNLRKDIEIVYYEHQFG

SEQ ID NO: 11643 - protein, 71 aa, Homo Sapiens
MDHLNEATQGKEHSEMSNNVSDPKGPPAKIARLEQNGSPLGRGRLGSTGAKMQGVPLKHSGHLMKTNLRKG

SEQ ID NO: 11644 - protein, 116 aa, Homo Sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALL

SEQ ID NO: 11645 - protein, 130 aa, Homo Sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKG

SEQ ID NO: 11646 - protein, 166 aa, Homo Sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTL

SEQ ID NO: 11647 - protein, 172 aa, Homo Sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHR

SEQ ID NO: 11648 - protein, 224 aa, Homo Sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTY

SEQ ID NO: 11649 - protein, 763 aa, Homo Sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTYYANVSAAKCQEFGRWYKHFKKTKDMMVEMDSLSELSQQGANHVNFGQQPVPGNTAEQPPSPAQLSHGSQPSVRTPLPNLHPGLVSTPISPQLVNQQLVMAQLLNQQYAVNRLLAQQSLNQQYLNHPPPVSRSMNKPLEQQVSTNTEVSSEIYQWVRDELKRAGISQAVFARVAFNRTQGLLSEILRKEEDPKTASQSLLVNLRAMQNFLQLPEAERDRIYQDERERSLNAASAMGPAPLISTPPSRPPQVKTATIATERNGKPENNTMNINASIYDEIQQEMKRAKVSQALFAKVAATKSQGWLCELLRWKEDPSPENRTLWENLSMIRRFLSLPQPERDAIYEQESNAVHHHGDRPPHIIHVPAEQIQQQQQQQQQQQQQQQAPPPPQPQQQPQTGPRLPPRQPTVASPAESDEENRQKTRPRTKISVEALGILQSFIQDVGLYPDEEAIQTLSAQLDLPKYTIIKFFQNQRYYLKHHGKLKDNSGLEVDVAEYKEEELLKDLEESVQDKNTNTLFSVKLEEELSVEGNTDINTDLKD

SEQ ID NO: 11650 - protein, 763 aa, Homo Sapiens; identical to SEQ ID NO: 11649

SEQ ID NO: 11651 - protein, 795 aa, Homo Sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTYYANVSAAKCQEFGRWYKHFKKTKDMMVEMDSLSELSQQGANHVNFGQQPVPGNTAEQPPSPAQLSHGSQPSVRTPLPNLHPGLVSTPISPQLVNQQLVMAQLLNQQYAVNRLLAQQSLNQQYLNHPPPVSRSMNKPLEQQVSTNTEVSSEIYQWVRDELKRAGISQAVFARVAFNRTQGLLSEILRKEEDPKTASQSLLVNLRAMQNFLQLPEAERDRIYQDERERSLNAASAMGPAPLISTPPSRPPQVKTATIATERNGKPENNTMNINASIYDEIQQEMKRAKVSQALFAKVAATKSQGWLCELLRWKEDPSPENRTLWENLSMIRRFLSLPQPERDAIYEQESNAVHHHGDRPPHIIHVPAEQIQSPSPTTLGKGESRGVFLPGLPTPAPWLGAAPQQQQQQQQQQQQQQQAPPPPQPQQQPQTGPRLPPRQPTVASPAESDEENRQKTRPRTKISVEALGILQSFIQDVGLYPDEEAIQTLSAQLDLPKYTIIKFFQNQRYYLKHHGKLKDNSGLEVDVAEYKEEELLKDLEESVQDKNTNTLFSVKLEEELSVEGNTDINTDLKD

SEQ ID NO: 11652 - protein, 138 aa, Homo Sapiens
MLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQHPEISNMLDNLFINGKINFKKKLPRAPEA

SEQ ID NO: 11653 - protein, 166 aa, Homo Sapiens
MLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTYYANVSAAKCQEFGR

SEQ ID NO: 11654 - protein, 41 aa, Homo Sapiens
MGAKSMRSWCLCQICSCGFLSSQPDHIPIPVQAAVLWDPPD

SEQ ID NO: 11655 - protein, 29 aa, Homo Sapiens
MGAKSMRSWCLCQICSCGPGLTREPLPLP

SEQ ID NO: 11656 - protein, 398 aa, Homo Sapiens
MGAKSMRSWCLCQICSCGSDYCPYEIVKQPRHVPEEYKPKQGKIDLGTTYKRDLNSYKVQPVAIVRPLERQVKKGKLDTVPTYKDDYRAWDLHKSELYKPEQTYHPPTVKFGNSTTFQDDFVPQEIKPRQSFKPSSVVKRSTAPFNGITSHRLDYIPHQLELKFERPKEVYKPTDQRFEDLTTHRCDFQGLIGETAKLCRPVHTRVTQNALFEGSTEFRESFQPWEIPPPEVKKVPEYVPPTGSMLLNSTSHLDYVPYQANHVVPIRPVSQKRSNNFPFQGKSIMKEDFPAWESCRQGLIKKQQQIPNPSGKFDGLSTFRSHYVPHELIPTESCKPLNIAFKSSVPFDDVTMYSVEYTPKRQEICPASYPSPPGYIFDNTNSQGHKFFRKIIPAVKAF

SEQ ID NO: 11657 - protein, 30 aa, Homo Sapiens
MYDNVLPPQSLKAKQEIRACHGKMEGITTF

SEQ ID NO: 11658 - protein, 104 aa, Homo Sapiens
MYDNVLPPQSLKAKQEIRACHGKMEGITTFKSDYCPYEIVKQPRHVPEEYKPKQGKIDLGTTYKRDLNSYKVQPVAIVRPLERQVKKGKLDTVPTYKGNLLFHT

SEQ ID NO: 11659 - protein, 149 aa, Homo Sapiens
GWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQGNHQSGSSSHQGGATTTPLASGASVNTPFINLPALWRSVANIMP

SEQ ID NO: 11660 - protein, 247 aa, Homo Sapiens
MHLARLVGSCSLLLLLGALSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQAGKEADKAVQGFHTGVHQAGKEAEKLGQGVNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 11661 - protein, 590 aa, Homo Sapiens
MHLARLVGSCSLLLLLGALSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQVGKEADKLIHHGVHHGANQAGSEAGKFGQGVDNAAGQAGNEAGRFGQGVHHAAGQAGNEAGRFGQGVHHAAGQAGNEAGRFGQGAHHGLSEGWKETEKFGQGIHHAAGQVGKEAEKFGQGAHHAAGQAGNEAGRFGQGVHHGLSEGWKETEKFGQGVHHTAGQVGKEAEKFGQGAHHAAGQAGNEAGRFGQGAHHAAGQAGNEAGRFGQGVHHGLSEGWKETEKFGQGVHHAASQFGKETEKLGHGVHHGVNEAWKEAEKFGQGVHHAASQVGKEEDRVVQGLHHGVSQAGREAGQFGHDIHHTAGQAGKEGDIAVHGVQPGVHEAGKEAGQFGQGVHHTLEQAGKEADKAVQGFHTGVHQAGKEAEKLGQGVNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 11662 - protein, 264 aa, Homo Sapiens
MRTLWMALCALSRLWPGAQAGCAEAGRCCPGRDPACFARGWRLDRVYGTCFCDQACRFTGDCCFDYDRACPARPCFVGEWSPWSGCADQCKPTTRVRRRSVQQEPQNGGAPCPPLEERAGCLEYSTPQGQDCGHTYVPAFITTSAFNKERTRQATSPHWSTHTEDAGYCMEFKTESLTPHCALENWPLTRWMQYLREGYTVCVDCQPPAMNSVSLRCSGDGLDSDGNQTLHWQAIGNPRCQGTWKKVRRVDQCSCPAVHSFIFI

SEQ ID NO: 11663 - protein, 49 aa, Homo Sapiens
MGLGLLLPLLLLWTRGTQGSELDPKGQHVCVASRWVSWESDACGQQPLC

SEQ ID NO: 11664 - protein, 830 aa, Homo Sapiens
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDTALIAGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPEEAEAPESFPAAASPGDSATGHRRPPLGGRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 11665 - protein, 744 aa, Homo Sapiens
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQPGSGSRDTALIAGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPEEAEAPESFPAAASPGDSATGHRRPPLGGRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 11666 - protein, 342 aa, Homo Sapiens
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRGPVIL

SEQ ID NO: 11667 - protein, 569 aa, Homo Sapiens
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDTALIAGSLVPLLLLFLGLACCACCCWAPRSDLKDRPARDGATVSRMKLQVWGTLTSLGSTLPCRSLSSHKLPWVTASSSRPLPAGPLMTPSHPILSLERQMRFLPTVCHPKKGWSLWPRQGRQRPAWLQVLSRPLRTPPRHSPSRAPPA

SEQ ID NO: 11668 - protein, 125 aa, Homo Sapiens
MAEAKTHWLGAALSLIPLIFLISGAEAASFQRNQLLQKEPDLRLENVQKFPSPEMIRALEYIENLRQQAHKEESSPDYNPYQGVSVPLQQKENGDESHLPERDSLSEEDWMRIILEALRQAENEP

SEQ ID NO: 11669 - protein, 144 aa, Homo Sapiens
MAEAKTHWLGAALSLIPLIFLISGAEAASFQRNQLLQKEPDLRLENVQKFPSPEMIRALEYIENLRQQAHKEESSPDYNPYQGVSVPLQQKENGDESHLPERDSLSEEDWMRIILEALRQAENEPQSAPKENKPYALNSEKNFP

SEQ ID NO: 11670 - protein, 617 aa, Homo Sapiens
MAEAKTHWLGAALSLIPLIFLISGAEAASFQRNQLLQKEPDLRLENVQKFPSPEMIRALEYIENLRQQAHKEESSPDYNPYQGVSVPLQQKENGDESHLPERDSLSEEDWMRIILEALRQAENEPQSAPKENKPYALNSEKNFPMDMSDDYETQQWPERKLKHMQFPPMYEENSRDNPFKRTNEIVEEQYTPQSLATLESVFQELGKLTGPNNQKRERMDEEQKLYTDDEDDIYKANNIAYEDVVGGEDWNPVEEKIESQTQEEVRDSKENIEKNEQINDEMKRSGQLGIQEEDLRKESKDQLSDDVSKVIAYLKRLVNAAGSGRLQNGQNGERATRLFEKPLDSQSIYQLIEISRNLQIPPEDLIEMLKTGEKPNGSVEPERELDLPVDLDDISEADLDHPDLFQNRMLSKSGYPKTPGRAGTEALPDGLSVEDILNLLGMESAANQKTSYFPNPYNQEKVLPRLPYGAGRSRSNQLPKAAWIPHVENRQMAYENLNDKDQELGEYLARMLVKYPEIINSNQVKRVPGQGSSEDDLQEEEQIEQAIKEHLNQGSSQETDKLAPVSKRFPVGPPKNDDTPNRQYWDEDLLMKVLEYLNQEKAEKGREHIAKRAMENM

SEQ ID NO: 11671 - protein, 57 aa, Homo Sapiens
MAAIQDGLAKGENDETVSNTLTLTNGLERRTKTYSEDNFEELQYFPNFYALLKSIDS

SEQ ID NO: 11672 - protein, 236 aa, Homo Sapiens
MAAIQDGLAKGENDETVSNTLTLTNGLERRTKTYSEDNFEELQYFPNFYALLKSIDSEKEAKEKETLITIMKTLIDFVKMMVKYGTISPEEGVSYLENLDEMIALQTKNKLEKNATDNISKLFPAPSEKSHEETDSTKEEAAKMEKEYGSLKDSTKDDNSNPGGKTDEPKGKTEAYLEAIRKNIEWLKKHDKKGNKEDYDLSKMRDFINKQADAYVEKGILDKEEAEAIKRIYSSL

SEQ ID NO: 11673 - protein, 468 aa, Homo Sapiens
MGFLGTGTWILVLVLPIQAFPKPGGSQDKSLHNRELSAERPLNEQIAEAEEDKIKKTYPPENKPGQSNYSFVDNLNLLKAITEKEKIEKERQSIRSSPLDNKLNVEDVDSTKNRKLIDDYDSTKSGLDHKFQDDPDGLHQLDGTPLTAEDIVHKIAARIYEENDRAVFDKIVSKLLNLGLITESQAHTLEDEVAEVLQKLISKEANNYEEDPNKPTSWTENQAGKIPEKVTPMAAIQDGLAKGENDETVSNTLTLTNGLERRTKTYSEDNFEELQYFPNFYALLKSIDSEKEAKEKETLITIMKTLIDFVKMMVKYGTISPEEGVSYLENLDEMIALQTKNKLEKNATDNISKLFPAPSEKSHEETDSTKEEAAKMEKEYGSLKDSTKDDNSNPGGKTDEPKGKTEAYLEAIRKNIEWLKKHDKKGNKEDYDLSKMRDFINKQADAYVEKGILDKEEAEAIKRIYSSL

SEQ ID NO: 11674 - protein, 212 aa, Homo Sapiens
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTADDGCLENTPDTAEFSREFQLHQHLFDPEHDYPGLGKWNKKLLYEKMKGGERRKRRSVNPYLQGQRLDNVVAKKSVPHFSDEDKDPE

SEQ ID NO: 11675 - protein, 194 aa, Homo Sapiens
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTADDGCLENTPDTAEFSREFQLHQHLFDPEHDYPGLGKWSVNPYLQGQRLDNVVAKKSVPHFSDEDKDPE

SEQ ID NO: 11676 - protein, 211 aa, Homo Sapiens
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTDDGCLENTPDTAEFSREFQLHQHLFDPEHDYPGLGKWNKKLLYEKMKGGERRKRRSVNPYLQGQRLDNVVAKKSVPHFSDEDKDPE

SEQ ID NO: 11677 - protein, 193 aa, Homo Sapiens
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTDDGCLENTPDTAEFSREFQLHQHLFDPEHDYPGLGKWSVNPYLQGQRLDNVVAKKSVPHFSDEDKDPE

SEQ ID NO: 11678 - protein, 216 aa, Homo Sapiens
SGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTADDGCLENTPDTAEFSREFQLHQHLFDPEHDYPGLGKWNKKLLYEKMKGGERRKRRVTRAWLDCCGDAWSFLSGAVNRLKPSLVGKSQNPPLCSPEKHWSM

SEQ ID NO: 11679 - protein, 56 aa, Homo Sapiens
MDTPSSYEAAMELFSPDQDMREAGAQLKKLVDTLPQKPRESIIKLMEKIAQSSLCN

SEQ ID NO: 11680 - protein, 91 aa, Homo Sapiens
MKLAVTLTLVTLALCCSSASAEICPSFQRVIETLLMDTPSSYEAAMELFSPDQDMREAGAQLKKLVDTLPQKPRESIIKLMEKIAQSSLCN

SEQ ID NO: 11681 - protein, 95 aa, Homo Sapiens
MKGSRALLLVALTLFCICRMATGEDNDEFFMDFLQTLLVGTPEELYEGTLGKYNVNEDAKAAMTELKSCIDGLQPMHKAELVKLLVQVLGSQDGA

SEQ ID NO: 11682 - protein, 95 aa, Homo Sapiens
MKGSRALLLVALTLFCICRMATGEDNDEFFMDFLQTLLVGTPEELYEGTLGKYNVNEDAKAAMTELKSCRDGLQPMHKAELVKLLVQVLGSQDGA

SEQ ID NO: 11683 - protein, 90 aa, Homo Sapiens
MRLSVCLLLLTLALCCYRANAVVCQALGSEITGFLLAGKPVFKFQLAKFKAPLEAVAAKMEVKKCVDTMAYEKRVLITKTLGKIAEKCDR

SEQ ID NO: 11684 - protein, 90 aa, Homo Sapiens
MKLSVCLLLVTLALCCYQANAEFCPALVSELLDFFFISEPLFKLSLAKFDAPPEAVAAKLGVKRCTDQMSLQKRSLIAEVLVKILKKCSV

SEQ ID NO: 11685 - protein, 83 aa, Homo Sapiens
MRLSVCLLMVSLALCCYQAHALVCPAVASEITVFLFLSDAAVNLQVAKLNPPPEALAAKLEVKHCTDQISFKKRLSLKKSWWK

SEQ ID NO: 11686 - protein, 95 aa, Homo Sapiens
MKLLMVLMLAALLLHCYADSGCKLLEDMVEKTINSDISIPEYKELLQEFIDSDAAAEAMGKFKQCFLNQSHRTLKNFGLMMHTVYDSIWCNMKSN

SEQ ID NO: 11687 - protein, 93 aa, Homo Sapiens
MKLLMVLMLAALSQHCYAGSGCPLLENVISKTINPQVSKTEYKELLQEFIDDNATTNAIDELKECFLNQTDETLSNVEVFMQLIYDSSLCDLF

SEQ ID NO: 11688 - protein, 120 aa, Homo Sapiens
MKLLMVLMLAALSQHCYAGSGCPLLENVISKTINPQVSKTEYKELLQEFIDDNATTNAIDELKECFLNQTDETLSNVEVFMVISFSSYKLFKSPDQGQVGSSFLTDNAKATSEQAFSYIG

SEQ ID NO: 11689 - protein, 96 aa, Homo Sapiens
MRVTSATCALLLALICSVQLGDACLDIDKLLANVVFDVSQDLLKEELARYNPSPLTEESFLNVQQCFANVSVTERFAHSVVIKKILQSNDCIEAAF

SEQ ID NO: 11690 - protein, 96 aa, Homo Sapiens; identical to SEQ ID NO: 11689

SEQ ID NO: 11691 - protein, 104 aa, Homo Sapiens
MKLAALLGLCVALSCSSAAAFLVGSAKPVAQPVAALESAAEAGAGTLANPLGTLNPLKLLLSSLGIPVNHLIEGSQKCVAELGPQAVGAVKALKALLGALTVFG

SEQ ID NO: 11692 - protein, 48 aa, Homo Sapiens
MDPLKLLLKTLGISVEHLVEGLRKCVNELGPEASEAVKKLLEALSHLV

SEQ ID NO: 11693 - protein, 93 aa, Homo Sapiens
MKLVTIFLLVTISLCSYSATAFLINKVPLPVDKLAPLPLDNILPFMDPLKLLLKTLGISVEHLVEGLRKCVNELGPEASEAVKKLLEALSHLV

SEQ ID NO: 11694 - protein, 218 aa, Homo Sapiens
MGRLLALVVGAALVSSACGGCVEVDSETEAVYGMTFKILCISCKRRSETNAETFTEWTFRQKGTEEFVKILRYENEVLQLEEDERFEGRVVWNGSRGTKDLQDLSIFITNVTYNHSGDYECHVYRLLFFENYEHNTSVVKKIHIEVVDKANRDMASIVSEIMMYVLIVVLTIWLVAEMIYCYKKIAAATETAAQENASEYLAITSESKENCTGVQVAE

SEQ ID NO: 11695 - protein, 218 aa, Homo Sapiens; identical to SEQ ID NO: 11694

SEQ ID NO: 11696 - protein, 268 aa, Homo Sapiens
MGRLLALVVGAALVSSACGGCVEVDSETEAVYGMTFKILCISCKRRSETNAETFTEWTFRQKGTEEFVKILRYENEVLQLEEDERFEGRVVWNGSRGTKDLQDLSIFITNVTYNHSGDYECHVYRLLFFENYEHNTSVVKKIHIEVVDKGESGAACPFTVTHRRARWRDRWQAVDRTGWLCAWPANRPQQRAEGEGSSPSCPLQLWPLFLSSPRRGQSMPVPHRRSGYRTQLCHLCCMTSGRCLLSLSQRVVLGLPGIIIRCVSRGVV

SEQ ID NO: 11697 - protein, 147 aa, Homo Sapiens
MGRLLALVVGAALVSSACGGCVEVDSETEAVYGMTFKILCISCKRRSETNAETFTEWTFRQKGTEEFVKKIHIEVVDKANRDMASIVSEIMMYVLIVVLTIWLVAEMIYCYKKIAAATETAAQENASEYLAITSESKENCTGVQVAE

SEQ ID NO: 11698 - protein, 185 aa, Homo Sapiens
MTFKILCISCKRRSETNAETFTEWTFRQKGTEEFVKILRYENEVLQLEEDERFEGRVVWNGSRGTKDLQDLSIFITNVTYNHSGDYECHVYRLLFFENYEHNTSVVKKIHIEVVDKANRDMASIVSEIMMYVLIVVLTIWLVAEMIYCYKKIAAATETAAQENASEYLAITSESKENCTGVQVAE

SEQ ID NO: 11699 - protein, 235 aa, Homo Sapiens
MTFKILCISCKRRSETNAETFTEWTFRQKGTEEFVKILRYENEVLQLEEDERFEGRVVWNGSRGTKDLQDLSIFITNVTYNHSGDYECHVYRLLFFENYEHNTSVVKKIHIEVVDKGESGAACPFTVTHRRARWRDRWQAVDRTGWLCAWPANRPQQRAEGEGSSPSCPLQLWPLFLSSPRRGQSMPVPHRRSGYRTQLCHLCCMTSGRCLLSLSQRVVLGLPGIIIRCVSRGVV

SEQ ID NO: 11700 - protein, 93 aa, Homo Sapiens
MPAFNRLFPLASLVLIYWVSVCFPVCVEVPSETEAVQGNPMKLRCISCMKREEVEATTVVEWFYRPEGGKDFLIYEYRNGHQEVESPFQGRLQ

SEQ ID NO: 11701 - protein, 141 aa, Homo Sapiens
MPAFNRLFPLASLVLIYWVSVCFPVCVEVPSETEAVQGNPMKLRCISCMKREEVEATTVVEWFYRPEGGKDFLIYEYRNGHQEVESPFQGRLQWNGSKDLQDVSITVLNVTLNDSGLYTCNVSREFEFEAHRPFVKTTRLI

SEQ ID NO: 11702 - protein, 215 aa, Homo Sapiens
MPAFNRLFPLASLVLIYWVSVCFPVCVEVPSETEAVQGNPMKLRCISCMKREEVEATTVVEWFYRPEGGKDFLIYEYRNGHQEVESPFQGRLQWNGSKDLQDVSITVLNVTLNDSGLYTCNVSREFEFEAHRPFVKTTRLIPLRVTEEAGEDFTSVVSEIMMYILLVFLTLWLLIEMIYCYRKVSKAEEAAQENASDYLAIPSENKENSAVPVEE

SEQ ID NO: 11703 - protein, 215 aa, Homo Sapiens; identical to SEQ ID NO: 11702

SEQ ID NO: 11704 - protein, 215 aa, Homo Sapiens; identical to SEQ ID NO: 11702

SEQ ID NO: 11705 - protein, 147 aa, Homo Sapiens
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPFSEGPSSATLRGLPWVIPGSPLLIRCSPGDLTCTACLFSKTKVWQRCLRLQSKY

SEQ ID NO: 11706 - protein, 147 aa, Homo Sapiens; identical to SEQ ID NO: 11705

SEQ ID NO: 11707 - protein, 452 aa, Homo Sapiens
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPLDSDLKPRKTTWLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPVDSVLSWGPYLYSMSLLEDKGLAEVSKVAEQVLNAVNKGLYREATELWGKAEMIIEQNTDGVNFYNILTKSTPTSTMESSLEFTQSHLVCLCQRHVRHLQRDALSQLMNGPIRKKLKIIPEDQSWGGQATNVFVNMEEDFMKPVISIVDELLEAGINVTVYNGQLDLIVDTMGQEAWVRKLKWPELPKFSQLKWKALYSDPKSLETSAFVKSYKNLAFYWILKAGHMVPSDQGDMALKMMRLVTQQE

SEQ ID NO: 11708 - protein, 296 aa, Homo Sapiens
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPLDSDLKPRKTTWLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPVDSVLSWGPYLYSMSLLEDKGLAEVSKVAEQVLNAVNKGLYREATELWGKAEMIIEQNTDGVNFYNILTKSTPTSTMESSLEFTQSHLVWF

SEQ ID NO: 11709 - protein, 176 aa, Homo Sapiens
MELALRRSPVPRWLLLLPLLLGLNAGAVIDWPTEEGKEVWDYVTVRKDAYMFWWLYYATNSCKNFSELPLVMWLQLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPV

SEQ ID NO: 11710 - protein, 69 aa, Homo Sapiens
MELALRRSPVPRWLLLLPLLLGLNAGSMGLCDGPQGCLHVLVALLCHQLLQELLRTAPGHVASGRSRRF

SEQ ID NO: 11711 - protein, 95 aa, Homo Sapiens
MVASDMMVLLKTFFSCHKEFQTVPFYIFSESYGGKMAAGIGLELYKAIQRGTIKCNFAGVALGDSWISPVDSVLSWGPYLYSMSLLEDKGLAEVS

SEQ ID NO: 11712 - protein, 135 aa, Homo Sapiens
  misc_feature (1)..(1): Xaa can be any naturally occurring amino acid
XTMESSLEFTQSHLGQATNVFVNMEEDFMKPVISIVDELLEAGINVTVYNGQLDLIVDTMGQEAWVRKLKWPELPKFSQLKWKALYSDPKSLETSAFVKSYKNLAFYWILKAGHMVPSDQGDMALKMMRLVTQQE

SEQ ID NO: 11713 - protein, 92 aa, Homo Sapiens
MKLMVLVFTIGLTLLLGVQAMPANRLSCYRKILKDHNCHNLPEGVADLTQIDVNVQDHFWDGKGCEMICYCNFSELLCCPKCHHIFILLRNL

SEQ ID NO: 11714 - protein, 98 aa, Homo Sapiens
MKLMVLVFTIGLTLLLGVQAMPANRLSCYRKILKDHNCHNLPEGVADLTQIDVNVQDHFWDGKGCEMICYCNFSELLCCPKDVFFGPKISFVIPCNNQ

SEQ ID NO: 11715 - protein, 121 aa, Homo Sapiens
MAPRPLLLLLLLLGGSAARPAPPRARRHSDGTFTSELSRLREGARLQRLLQGLVGKRSEQDAENSMAWTRLSAGLLCPSGSNMPILQAWMPLDGTWSPWLPPGPMVSEPAGAAAEGTLRPR

SEQ ID NO: 11716 - protein, 347 aa, Homo Sapiens
MGAAAVRWHLCVLLALGTRGRLAGGSGLPGSVDVDECSEGTDDCHIDAICQNTPKSYKCLCKPGYKGEGKQCEDIDECENDYYNGGCVHECINIPGNYRCTCFDGFMLAHDGHNCLDVDECQDNNGGCQQICVNAMGSYECQCHSGFFLSDNQHTCIHRSNEGMNCMNKDHGCAHICRETPKGGVACDCRPGFDLAQNQKDCTLTCNYGNGGCQHSCEDTDTGPTCGCHQKYALHSDGRTCIEKDEAAIERSQFNATSVADVDKRVKRRLLMETCAVNNGGCDRTCKDTATGVRCSCPVGFTLQPDGKTCKGQHVELCGCPCLYWPGQEPPCACIAGPRAGLNGGHV

SEQ ID NO: 11717 - protein, 988 aa, Homo Sapiens
MGAAAVRWHLCVLLALGTRGRLAGGSGLPGSVDVDECSEGTDDCHIDAICQNTPKSYKCLCKPGYKGEGKQCEDIDECENDYYNGGCVHECINIPGNYRCTCFDGFMLAHDGHNCLDVDECQDNNGGCQQICVNAMGSYECQCHSGFFLSDNQHTCIHRSNEGMNCMNKDHGCAHICRETPKGGVACDCRPGFDLAQNQKDCTLTCNYGNGGCQHSCEDTDTGPTCGCHQKYALHSDGRTCIETCAVNNGGCDRTCKDTATGVRCSCPVGFTLQPDGKTCKDINECLVNNGGCDHFCRNTVGSFECGCRKGYKLLTDERTCQDIDECSFERTCDHICINSPGSFQCLCHRGYILYGTTHCGDVDECSMSNGSCDQGCVNTKGSYECVCPPGRRLHWNGKDCVETGKCLSRAKTSPRAQLSCSKAGGVESCFLSCPAHTLFVPDSENSYVLSCGVPGPQGKALQKRNGTSSGLGPSCSDAPTTPIKQKARFKIRDAKCHLRPHSQARAKETARQPLLDHCHVTFVTLKCDSSKKRRRGRKSPSKEVSHITAEFEIETKMEEASDTCEADCLRKRAEQSLQAAIKTLRKSIGRQQFYVQVSGTEYEVAQRPAKALEGQGACGAGQVLQDSKCVACGPGTHFGGELGQCVSCMPGTYQDMEGQLSCTPCPSSDGLGLPGARNVSECGGQCSPGFFSADGFKPCQACPVGTYQPEPGRTGCFPCGGGLLTKHEGTTSFQDCEAKVHCSPGHHYNTTTHRCIRCPVGTYQPEFGQNHCITCPGNTSTDFDGSTNVTHCKNQHCGGELGDYTGYIESPNYPGDYPANAECVWHIAPPPKRRILIVVPEIFLPIEDECGDVLVMRKSASPTSITTYETCQTYERPIAFTSRSRKLWIQFKSNEGNSGKGFQVPYVTYDEDYQQLIEDIVRDGRLYASENHQEILKDKKLIKALFDVLAHPQNYFKYTAQESKEMFPRSFIKLLRSKVSRFLRPYK

SEQ ID NO: 11718 - protein, 363 aa, Homo Sapiens [sequence omitted]

SEQ ID NO: 11719 - protein, 175 aa, Homo Sapiens
  misc_feature (1)..(1): Xaa can be any naturally occurring amino acid
XRETPKGGVACDCRPGFDLAQNQKDCTLTCNYGNGGCQHSCEDTDTGPTCGCHQKYALHSDGRTCIEKDEAAIERSQFNATSVADVDKRVKRRLLMETCAVNNGGCDRTCKDTATGVRCSCPVGFTLQPDGKTCKDINECLVNNGGCDHFCRNTVGSFECGCRKGYKLLTDERTC

SEQ ID NO: 11720 - protein, 999 aa, Homo Sapiens
MGVAGRNRPGAAWAVLLLLLLLPPLLLLAGAVPPGRGRAAGPQEDVDECAQGLDDCHADALCQNTPTSYKCSCKPGYQGEGRQCEDIDECGNELNGGCVHDCLNIPGNYRCTCFDGFMLAHDGHNCLDVDECLENNGGCQHTCVNVMGSYECCCKEGFFLSDNQHTCIHRSEEGLSCMNKDHGCSHICKEAPRGSVACECRPGFELAKNQRDCILTCNHGNGGCQHSCDDTADGPECSCHPQYKMHTDGRSCLEREDTVLEVTESNTTSVVDGDKRVKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGDTNECSINNGGCQQVCVNTVGSYECQCHPGYKLHWNKKDCVEVKGLLPTSVSPRVSLHCGKSGGGDGCFLRCHSGIHLSSDVTTIRTSVTFKLNEGKCSLKNAELFPEGLRPALPEKHSSVKESFRYVNLTCSSGKQVPGAPGRPSTPKEMFITVEFELETNQKEVTASCDLSCIVKRTEKRLRKAIRTLRKAVHREQFHLQLSGMNLDVAKKPPRTSERQAESCGVGQGHAENQCVSCRAGTYYDGARERCILCPNGTFQNEEGQMTCEPCPRPGNSGALKTPEAWNMSECGGLCQPGEYSADGFAPCQLCALGTFQPEAGRTSCFPCGGGLATKHQGATSFQDCETRVQCSPGHFYNTTTHRCIRCPVGTYQPEFGKNNCVSCPGNTTTDFDGSTNITQCKNRRCGGELGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 11721 - protein, 807 aa, Homo Sapiens
MGVAGRNRPGAAWAVLLLLLLLPPLLLLAGAVPPGRGRAAGPQEDVDECAQGLDDCHADALCQNTPTSYKCSCKPGYQGEGRQCEDIDECGNELNGGCVHDCLNIPGNYRCTCFDGFMLAHDGHNCLDVDECLENNGGCQHTCVNVMGSYECCCKEGFFLSDNQHTCIHRSEEGLSCMNKDHGCSHICKEAPRGSVACECRPGFELAKNQRDCILTCNHGNGGCQHSCDDTADGPECSCHPQYKMHTDGRSCLEREDTVLEVTESNTTSVVDGDKRVKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGDTNECSINNGGCQQVCVNTVGSYECQCHPGYKLHWNKKDCVASCDLSCIVKRTEKRLRKAIRTLRKAVHREQFHLQLSGMNLDVAKKPPRTSERQAESCGVGQGHAENQCVSCRAGTYYDGARERCILCPNGTFQNEEGQMTCEPCPRPGNSGALKTPEAWNMSECGGLCQPGEYSADGFAPCQLCALGTFQPEAGRTSCFPCGGGLATKHQGATSFQDCETRVQCSPGHFYNTTTHRCIRCPVGTYQPEFGKNNCVSCPGNTTTDFDGSTNITQCKTSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 11722 - protein, 971 aa, Homo Sapiens
MGVAGRNRPGAAWAVLLLLLLLPPLLLLAGAVPPGRGRAAGPQEDVDECAQGLDDCHADALCQNTPTSYKCSCKPGYQGEGRQCEDIDECGNELNGGCVHDCLNIPGNYRCTCFDGFMLAHDGHNCLDVDECLENNGGCQHTCVNVMGSYECCCKEGFFLSDNQHTCIHRSEEGLSCMNKDHGCSHICKEAPRGSVACECRPGFELAKNQRDCILTCNHGNGGCQHSCDDTADGPECSCHPQYKMHTDGRSCLEREDTVLEVTESNTTSVVDGDKRVKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGDTNECSINNGGCQQVCVNTVGSYECQCHPGYKLHWNKKDCVEVKGLLPTSVSPRVSLHCGKSGGGDGCFLRCHSGIHLSSGLQGAYSVTCGSSSPLRNKQQKSNDSAFGDVTTIRTSVTFKLNEGKCSLKNAELFPEGLRPALPEKHSSVKESFRYVNLTCSSGKQVPGAPGRPSTPKEMFITVEFELETNQKEVTASCDLSCIVKRTEKRLRKAIRTLRKAVHREQFHLQLSGMNLDVAKKPPRTSERQAESCGVGQGHAENQCGLCQPGEYSADGFAPCQLCALGTFQPEAGRTSCFPCGGGLATKHQGATSFQDCETRVQCSPGHFYNTTTHRCIRCPVGTYQPEFGKNNCVSCPGNTTTDFDGSTNITQCKNRRCGGELGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 11723 - protein, 172 aa, Homo Sapiens
  misc_feature (1)..(1): Xaa can be any naturally occurring amino acid
XCSCHPQYKMHTDGRSCLEREDTVLEVTESNTTSVVDGDKRVKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGEVKGL

SEQ ID NO: 11724 - protein, 112 aa, Homo Sapiens
  misc_feature (1)..(1): Xaa can be any naturally occurring amino acid
XGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDDA

SEQ ID NO: 11725 - protein, 192 aa, Homo Sapiens
  misc_feature (1)..(1): Xaa can be any naturally occurring amino acid
XKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGDTNECSINNGGCQQVCVNTVGSYECQCHPGYKLHWNKKDCVVKGLLPTSVSPRVSLHCGKSGGGDG

SEQ ID NO: 11726 - protein, 119 aa, Homo Sapiens
  misc_feature (1)..(1): Xaa can be any naturally occurring amino acid
XYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDGKHSLQHMERASLL

SEQ ID NO: 11727 - protein, 993 aa, Homo Sapiens
MGSGRVPGLCLLVLLVHARAAQYSKAAQDVDECVEGTDNCHIDAICQNTPRSYKCICKSGYTGDGKHCKDVDECEREDNAGCVHDCVNIPGNYRCTCYDGFHLAHDGHNCLDVDECAEGNGGCQQSCVNMMGSYECHCREGFFLSDNQHTCIQRPEEGMNCMNKNHGCAHICRETPKGGIACECRPGFELTKNQRDCKLTCNYGNGGCQHTCDDTEQGPRCGCHIKFVLHTDGKTCIETCAVNNGGCDSKCHDAATGVHCTCPVGFMLQPDRKTCKDIDECRLNNGGCDHICRNTVGSFECSCKKGYKLLINERNCQDIDECSFDRTCDHICVNTPGSFQCLCHRGYLLYGITHCGDVDECSINRGGCRFGCINTPGSYQCTCPAGQGRLHWNGKDCTEPLKCQGSPGASKAMLSCNRSGKKDTCALTCPSRARFLPESENGFTVSCGTPSPRAAPARAGHNGNSTNSNHCHEAAVLSIKQRASFKIKDAKCRLHLRNKGKTEEAGRITGPGGAPCSECQVTFIHLKCDSSRKGKGRRARTPPGKEVTRLTLELEAEVRAEETTASCGLPCLRQRMERRLKGSLKMLRKSINQDRFLLRLAGLDYELAHKPGLVAGERAEPMESCRPGQHRAGTKCVSCPQGTYYHGQTEQCVPCPAGTFQEREGQLSCDLCPGSDAHGPLGATNVTTCAGQCPPGQHSVDGFKPCQPCPRGTYQPEAGRTLCFPCGGGLTTKHEGAISFQDCDTKVQCSPGHYYNTSIHRCIRCAMGSYQPDFRQNFCSRCPGNTSTDFDGSTSVAQCKNRQCGGELGEFTGYIESPNYPGNYPAGVECIWNINPPPKRKILIVVPEIFLPSEDECGDVLVMRKNSSPSSITTYETCQTYERPIAFTARSRKLWINFKTSEANSARGFQIPYVTYDEDYEQLVEDIVRDGRLYASENHQEILKDKKLIKAFFEVLAHPQNYFKYTEKHKEMLPKSFIKLLRSKVSSFLRPYK

SEQ ID NO: 11728 - protein, 310 aa, Homo Sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHLASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 11729 - protein, 310 aa, Homo Sapiens; identical to SEQ ID NO: 11728

SEQ ID NO: 11730 - protein, 169 aa, Homo Sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHLASTTTATTAQEPATSHPHRDMQPVHFVSWGGLI

SEQ ID NO: 11731 - protein, 28 aa, Homo Sapiens
MRRAALWLWLCALALSLQPALPSLSHGR

SEQ ID NO: 11732 - protein, 215 aa, Homo Sapiens
PRWPGEPGQGCVGGAGERLQGPRACRGRLEQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHLASTTTATTAQEPATSHPHRDMQPGHHETSTPAGPSQADLHTPHTEDGGPSATERAAEDGASSQLPAAEGSG

SEQ ID NO: 11733 - protein, 211 aa, Homo Sapiens
MAVVPLLLLGGLWSAVGASSLGVVTCGSVVKLLNTRHNVRLHSHDVRYGSGSGQQSVTGVTSVDDSNSYWRIRGKSATVCERGTPIKCGQPIRLTHVNTGRNLHSHHFTSPLSGNQEVSAFGEEGEGDYLDDWTVLCNGPYWVRDGEVRFKHSSTEVLLSVTGEQYGRPISGQKEVHGMAQPSQNNYWKAMEGIFMKPSELLKAEAHHAEL

SEQ ID NO: 11734 - protein, 104 aa, Homo Sapiens
SLGVVTCGSVVKLLNTRHNVRLHSHDVRYGSGSGQQSVTGVTSVDDSNSYWRIRGKSATVCERGTPIKCGQPIRLTHVNTGRNLHSHHFTSPLSGNQLLCKVIL

SEQ ID NO: 11735 - protein, 50 aa, Homo Sapiens
  misc_feature (1)..(1): Xaa can be any naturally occurring amino acid
XRNLHSHHFTSPLSGNQENNMVDLSVGKKRCMAWPSQVRTTTGKPWKASS

SEQ ID NO: 11736 - protein, 221 aa, Homo Sapiens
MWSAGRGGAAWPVLLGLLLALLVPGGGAAKTGAELVTCGSVLKLLNTHHRVRLHSHDIKYGSGSGQQSVTGVEASDDANSYWRIRGGSEGGCPRGSPVRCGQAVRLTHVLTGKNLHTHHFPSPLSNNQEVSAFGEDGEGDDLDLWTVRCSGQHWEREAAVRFQHVGTSVFLSVTGEQYGSPIRGQHEVHGMPSANTHNTWKAMEGIFIKPSVEPSAGHDEL

SEQ ID NO: 11737 - protein, 254 aa, Homo Sapiens
MVWPWVAMASRWGPLIGLAPCCLWLLGAVLLMDASARPANHSSTRERVANREENEILPPDHLNGVKLEMDGHLNRGFHQEVFLGKDLGGFDEDAEPRRSRRKLMVIFSKVDVNTDRKISAKEMQRWIMEKTAEHFQEAMEESKTHFRAVDPDGDGHVSWDEYKVKFLASKGHSEKEVADAIRLNEELKVDEESCAPLSTGSPGEPEGPLVPGGQPPCRPAADGGGVPVVPPPRAQPGNAQVHGEGDRPGPGPGR

SEQ ID NO: 11738 - protein, 348 aa, Homo Sapiens
MVWPWVAMASRWGPLIGLAPCCLWLLGAVLLMDASARPANHSSTRERVANREENEILPPDHLNGVKLEMDGHLNRGFHQEVFLGKDLGGFDEDAEPRRSRRKLMVIFSKVDVNTDRKISAKEMQRWIMEKTAEHFQEAMEESKTHFRAVDPDGDGHVSWDEYKVKFLASKGHSEKEVADAIRLNEELKVDEETQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELENVPTLPLQPIGTLNSHFVRLAAELGGGKATLTCAPLARRATWTP

SEQ ID NO: 11739 - protein, 362 aa, Homo Sapiens
MVWPWVAMASRWGPLIGLAPCCLWLLGAVLLMDASARPANHSSTRERVANREENEILPPDHLNGVKLEMDGHLNRGFHQEVFLGKDLGGFDEDAEPRRSRRKLMVIFSKVDVNTDRKISAKEMQRWIMEKTAEHFQEAMEESKTHFRAVDPDGDGHVSWDEYKVKFLASKGHSEKEVADAIRLNEELKVDEETQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELESYMDPMNEYNALNEAKQMIAVADENQNHHLEPEEVLKYSEFFTGSKLVDYARSVHEEF

SEQ ID NO: 11740 - protein, 243 aa, Homo Sapiens
  misc_feature (1)..(1): Xaa can be any naturally occurring amino acid
XLEMDGHLNRGFHQEVFLGKDLGGFDEDAEPRRSRRKLMVIFSKVDVNTDRKISAKEMQRWIMEKTAEHFQEAMEESKTHFRAVDPDGDGHVSWDEYKVKFLASKGHSEKEVADAIRLNEELKVDEESSTSRNFLDLRAGVCRPRYPQAAPLSAQEVLENLKDRWYQADSPPADLLLTEEEFLSFLHPEHSRGMLRFMVKEIVRDLDQDGDKQLSVPEFISLPVGTVENQQGQDIDDNWVKDR

SEQ ID NO: 11741 - protein, 65 aa, Homo Sapiens
MAVSTVFSTSSLGIGLFVAVGSVSPSGKEDLGFPTPPSSPLAEVTTLTSYLDKLSTSLDWEPLGD

SEQ ID NO: 11742 - protein, 65 aa, Homo Sapiens; identical to SEQ ID NO: 11741

SEQ ID NO: 11743 - protein, 28 aa, Homo Sapiens
MAVSTVFSTSSLKLNQPQKYLKMKSWPC

SEQ ID NO: 11744 - protein, 88 aa, Homo Sapiens
MAVSTVFSTSSLMLALSRHSLLSPLLSVTSFRRFYRGDSPTDSQKDMIEIPLPPWQERTDESIETKRARLLYESRKRGMLENCILLRS

SEQ ID NO: 11745 - protein, 166 aa, Homo Sapiens
MAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATEAKPAPEIFENEVMALLRDFAKNKNKEQRLRAPDLEYLFEKPR

SEQ ID NO: 11746 - protein, 133 aa, Homo Sapiens
MAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATGSSDSPASAS

SEQ ID NO: 11747 - protein, 141 aa, Homo Sapiens
MAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATGTGYDKQHNVKIGQFRLI

SEQ ID NO: 11748 - protein, 129 aa, Homo Sapiens
MAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDWDIYYWATGWSAMA

SEQ ID NO: 11749 - protein, 108 aa, Homo Sapiens
MTPSRLPWLLSWVSATAWRAARSPLLCHSLRKTSSSQGGKSELVKQSLKKPKLPEGRFDAPEDSHLEKEPLEKFPDDVNPVTKEKGGPRGPEPTRYGDWERKGRCIDF

SEQ ID NO: 11750 - protein, 280 aa, Homo Sapiens
MAAVVALSLRRRLPATTLGGACLQASRGAQTAAATAPRIKKFAIYRWDPDKAGDKPHMQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQAYRWMIDSRDDFTEERLAKLQDPFSLYRCHTIMNCTRTCPKGLNPGKAIAEIKKMMATYKEKKASV

SEQ ID NO: 11751 - protein, 200 aa, Homo Sapiens
MFNLTLVHYKASRGAQTAAATAPRIKKFAIYRWDPDKAGDKPHMQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQ

SEQ ID NO: 11752 - protein, 123 aa, Homo Sapiens
MQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKL

SEQ ID NO: 11753 - protein, 120 aa, Homo Sapiens
MAVLWRLSAVCGALGGRAGSKAASLHWTSERVVSVLLLGLLPAAYLNPCSAMDYSLAAALTLHGHWGLGQVVTDYVHGDALQKAAKAGLLALSALTFAGLCYFNYHDVGICKAVAMLWKL

SEQ ID NO: 11754 - protein, 72 aa, Homo Sapiens
MAVLWRLSAVCGALGGRALLLRTPVVRPAHISAFLQDRPIPEWCGVQHIHLSPSHHCWSAVVRSRLTATSTF

SEQ ID NO: 11755 - protein, 131 aa, Homo Sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGALDKLLLTMFMGMPCRKLPRQGFWHFQL

SEQ ID NO: 11756 - protein, 104 aa, Homo Sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGH

SEQ ID NO: 11757 - protein, 159 aa, Homo Sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWGLGQVVTDYVHGDALQKAAKAGLLALSALTFAGLCYFNYHDVGICKAVAMLWKL

SEQ ID NO: 11758 - protein, 143 aa, Homo Sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWLECNGAILARHDLGSARSQLTATSAFRVQAILLPQPPK

SEQ ID NO: 11759 - protein, 143 aa, Homo Sapiens; identical to SEQ ID NO: 11758

SEQ ID NO: 11760 - protein, 85 aa, Homo Sapiens
MAVLWRLSAVCGALGGRALLLRTPVVRPAHISAFLQDRPIPEWCGVQHIHLSPSHHWALDKLLLTMFMGMPCRKLPRQGFWHFQL

SEQ ID NO: 11761 - protein, 55 aa, Homo Sapiens
  misc_feature (1)..(1): Xaa can be any naturally occurring amino acid
XGSKAASLHWTSERVVSVLLLGLLPAAYLNPCSAMDYSLAAALTLHGHWKIKNNE

SEQ ID NO: 11762 - protein, 101 aa, Homo Sapiens
  misc_feature (1)..(1): Xaa can be any naturally occurring amino acid
XWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGH

SEQ ID NO: 11763 - protein, 353 aa, Homo Sapiens
MEFRKTMDIDHILDWQPPEVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIPKSMYVRDQVKTQYEHSVQINRGSSHQVEYEILFPGCVLRWQFSSDGADIGFGVFLKTKMGERQRAGEMTDVLPSQRYNAHMVPEDGNLTCSEAGVYVESESGKSCCHLPVIICSHELQNSHSNSQVMAYQMVRKCKLSRPLPLPASN

SEQ ID NO: 11764 - protein, 341 aa, Homo Sapiens
MEFRKTMDIDHILDWQPPEVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIPKSMYVRDQVKTQYEHSVQINRGSSHQVEYEILFPGCVLRWQFSSDGADIGFGVFLKTKMGERQRAGEMTDVLPSQRYNAHMVPEDGNLTCSEAGVYVLRFDNTYSFVHAKKVSFTVEVLLPDEGMQKYDKELTPV

SEQ ID NO: 11765 - protein, 400 aa, Homo Sapiens
MSGRVGDLSPKQAETLAKFRENVQDVLPALPNPDDYFLLRWLRARNFDLQKSEALLRKYMEFRKTMDIDHILDWQPPEVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIPKSMYVRDQVKTQYEHSVQINRGSSHQVEYEILFPGCVLRWQFSSDGADIGFGVFLKTKMGERQRAGEMTDVLPSQRYNAHMVPEDGNLTCSEAGVYVLRFDNTYSFVHAKKVSFTVEVLLPDEGMQKYDKELTPV

SEQ ID NO: 11766 - protein, 51 aa, Homo Sapiens
MSGRVGDLSPKQAETLAKMESLSSRLECCGAISAHCSLCLPGSSNSPASAS

SEQ ID NO: 11767 - protein, 323 aa, Homo Sapiens
MVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIPKSMYVRDQVKTQYEHSVQINRGSSHQVEYEILFPGCVLRWQFSSDGADIGFGVFLKTKMGERQRAGEMTDVLPSQRYNAHMVPEDGNLTCSEAGVYVLRFDNTYSFVHAKKVSFTVEVLLPDEGMQKYDKELTPV

SEQ ID NO: 11768 - protein, 323 aa, Homo Sapiens; identical to SEQ ID NO: 11767

SEQ ID NO: 11769 - protein, 231 aa, Homo Sapiens
  misc_feature (1)..(1): Xaa can be any naturally occurring amino acid
XKTSRMCFLPCPTLMIISFYAGSEYMEFRKTMDIDHILDWQPPEVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIP

SEQ ID NO: 11770 - protein, 1059 aa, Homo Sapiens
ARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGEAPGDLPAAGGPPSGAMPFYNPAQLAQACATSGSSRLGRIGQRKHLVLN

SEQ ID NO: 11771 - protein, 385 aa, Homo Sapiens
MDLLPTSILLASLWICSHLHPPGVSVDLPPTSILLVSLWICSHLHPPGVSVDRPPPPSSWCLCGSPPTSILLVSLWICSPPPSSWCLCGSAPTSILLVSLWIWRLWGLTEGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPVSSVRPQGRSGRNDGLLALSSPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 11772 - protein, 2134 aa, Homo Sapiens
MPGLDRPLSRQNPHDGVVTPAASPSLPQPGLQMPGQWGPVQGGPQPSGQHRSPCPEGPVPSGVPCATSVPHFPTPSILHQGPGHEQHSPLVAPPAALPSDGRDEVSHLQSGSHLANNSDPESTFRQNPRIVNHWASPELRQNPGVKNEHRPASALVNPLARGDSPENRTHHPLGAGAGSGCAPLEADSGASGALAMFFQGGETENEENLSSEKAGLSGQADFDDFCSSPGLGRPPAPTHVGAGSLCQALLPGPSNEAAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKPEDEASGSFFKQIDSSPVGGETDETTVSQNYRGSVSQPSTPSPPKPTGIFQTSANSSFEPVKSHLVGVKPFEADRANVVGEVRETCVRQKQCRPAAALPDASPGNLEQPPDNMETLCAPQVCPLPLNSTTEAVHMLPHAGAPPLDTVYPAPEKRPSARTQGPVKCESPATTLWAQSELPDFGGNVLLAPAAPALYVCAKPQPPVVQPPEEAMSGQQSRNPSSAAPVQSRGGIGASENLENPPKMGEEEALQSQASSGYASLLSSPPTESLQNPPVLIAQPDHSYNLAQPINFSVSLSNSHEKNQSWREALVGDRPAVSSWALGGDSGENTSLSGIPTSSVLSLSLPSSVAQSNFPQGSGASEMVSNQPANLLVQPPSQPVPENLVPESQKDRKAGSALPGFANSPAGSTSVVLVPPAHGTLVPDGNKANHSSHQEDTYGALDFTLSRTLENPVNVYNPSHSDSLASQQSVASHPRQSGPGAPNLDRFYQQVTKDAQGQPGLERAQQELVPPQQQASPPQLPKAMFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKAPGDLPAAGGPPSGAMPFYNPAQLAQACATSGSSRLGRIGQRKHLVLN

SEQ ID NO: 11773 - protein, 2154 aa, Homo Sapiens
MPGLDRPLSRQNPHDGVVTPAASPSLPQPGLQMPGQWGPVQGGPQPSGQHRSPCPEGPVPSGVPCATSVPHFPTPSILHQGPGHEQHSPLVAPPAALPSDGRDEVSHLQSGSHLANNSDPESTFRQNPRIVNHWASPELRQNPGVKNEHRPASALVNPLARGDSPENRTHHPLGAGAGSGCAPLEADSGASGALAMFFQGGETENEENLSSEKAGLSGQADFDDFCSSPGLGRPPAPTHVGAGSLCQALLPGPSNEAAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKPEDEASGSFFKQIDSSPVGGETDETTVSQNYRGSVSQPSTPSPPKPTGIFQTSANSSFEPVKSHLVGVKPFEADRANVVGEVRETCVRQKQCRPAAALPDASPGNLEQPPDNMETLCAPQVCPLPLNSTTEAVHMLPHAGAPPLDTVYPAPEKRPSARTQGPVKCESPATTLWAQSELPDFGGNVLLAPAAPALYVCAKPQPPVVQPPEEAMSGQQSRNPSSAAPVQSRGGIGASENLENPPKMGEEEALQSQASSGYASLLSSPPTESLQNPPVLIAQPDHSYNLAQPINFSVSLSNSHEKNQSWREALVGDRPAVSSWALGGDSGENTSLSGIPTSSVLSLSLPSSVAQSNFPQGSGASEMVSNQPANLLVQPPSQPVPENLVPESQKDRKAGSALPGFANSPAGSTSVVLVPPAHGTLVPDGNKANHSSHQEDTYGALDFTLSRTLENPVNVYNPSHSDSLASQQSVASHPRQSGPGAPNLDRFYQQVTKDAQGQPGLERAQQELVPPQQQASPPQLPKAMFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKLSRCSSMSSLSREVSQHFNQAPGDLPAAGGPPSGAMPFYNPAQLAQACATSGSSRLGRIGQRKHLVLN

SEQ ID NO: 11774 - protein, 2357 aa, Homo Sapiens
MQPPPQTVPSGMAGPPPAGNPRSVFWASSPYRRRANNNAAVAPTTCPLQPVTDPFAFSRQALQSTPLGSSSKSSPPVLQGPAPAGFSQHPGLLVPHTHARDSSQGPCEPLPGPLTQPRAHASPFSGALTPSAPPGPEMNRSAEVGPSSEPEVQTLPYLPHYIPGVDPETSHGGHPHGNMPGLDRPLSRQNPHDGVVTPAASPSLPQPGLQMPGQWGPVQGGPQPSGQHRSPCPEGPVPSGVPCATSVPHFPTPSILHQGPGHEQHSPLVAPPAALPSDGRDEVSHLQSGSHLANNSDPESTFRQNPRIVNHWASPELRQNPGVKNEHRPASALVNPLARGDSPENRTHHPLGAGAGSGCAPLEADSGASGALAMFFQGGETENEENLSSEKAGLSGQADFDDFCSSPGLGRPPAPTHVGAGSLCQALLPGPSNEAAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKPEDEASGSFFKQIDSSPVGGETDETTVSQNYRGSVSQPSTPSPPKPTGIFQTSANSSFEPVKSHLVGVKPFEADRANVVGEVRETCVRQKQCRPAAALPDASPGNLEQPPDNMETLCAPQVCPLPLNSTTEAVHMLPHAGAPPLDTVYPAPEKRPSARTQGPVKCESPATTLWAQSELPDFGGNVLLAPAAPALYVCAKPQPPVVQPPEEAMSGQQSRNPSSAAPVQSRGGIGASENLENPPKMGEEEALQSQASSGYASLLSSPPTESLQNPPVLIAQPDHSYNLAQPINFSVSLSNSHEKNQSWREALVGDRPAVSSWALGGDSGENTSLSGIPTSSVLSLSLPSSVAQSNFPQGSGASEMVSNQPANLLVQPPSQPVPENLVPESQKDRKAGSALPGFANSPAGSTSVVLVPPAHGTLVPDGNKANHSSHQEDTYGALDFTLSRTLENPVNVYNPSHSDSLASQQSVASHPRQSGPGAPNLDRFYQQVTKDAQGQPGLERAQQELVPPQQQASPPQLPKAMFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 11775 - protein, 2334 aa, Homo Sapiens
MQPPPQTVPSGMAGPPPAGNPRSVFWASSPYRRRANNNAAVAPTTCPLQPVTDPFAFSRQALQSTPLGSSSKSSPPVLQGPAPAGFSQHPGLLVPHTHARDSSQGPCEPLPGPLTQPRAHASPFSGALTPSAPPGPEMNRSAEVGPSSEPEVQTLPYLPHYIPGVDPETSHGGHPHGNMPGLDRPLSRQNPHDGVVTPAASPSLPQPGLQMPGQWGPVQGGPQPSGQHRSPCPEGPVPSGVPCATSVPHFPTPSILHQGPGHEQHSPLVAPPAALPSDGRDEVSHLQSGSHLANNSDPESTFRQNPRIVNHWASPELRQNPGVKNEHRPASALVNPLARGDSPENRTHHPLGAGAGSGCAPLEADSGASGALAMFFQGGETENEENLSSEKAGLSGQADFDDFCSSPGLGRPPAPTHVGAGSLCQALLPGPSNEAAGDVWGDTASTGVPDASGSQYENVENLEFVQNQEVLPSEPLNLDPSSPSDQFRYGPLPGPAVPRHGAVCHTGAPDATLHTVHPDSVSSSYSSRSHGRLSGSARPQELVGTFIQQEVGKPEDEASGSFFKQIDSSPVGGETDETTVSQNYRGSVSQPSTPSPPKPTGIFQTSANSSFEPVKSHLVGVKPFEADRANVVGEVRETCVRQKQCRPAAALPDASPGNLEQPPDNMETLCAPQVCPLPLNSTTEAVHMLPHAGAPPLDTVYPAPEKRPSARTQGPVKCESPATTLWAQSELPDFGGNVLLAPAAPALYVCAKPQPPVVQPPEEAMSGQQSRNPSSAAPVQSRGGIGASENLENPPKMGEEEALQSQASSGYASLLSSPPTESLQNPPVLIAQPDHSYNLAQPINFSVSLSNSHEKNQSWREALVGDRPAVSSWALGGDSGENTSLSGIPTSSVLSLSLPSSVAQSNFPQGSGASEMVSNQPANLLVQPPSQPVPENLVPESQKDRKAGSALPGFANSPAGSTSVVLVPPAHGTLVPDGNKANHSSHQEDTYGALDFTLSRTLENPVNVYNPSHSDSLASQQSVASHPRQSGPGAPNLDRFYQQVTKDAQGQPGLERAQQELVPPQQQASPPQLPKAMFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPRQGYPEGYYSSKSGWSSQSDYYASYYSSQYDYGDPGHWDRYHYSARVRDPRTYDRRYWCDAEYDAYRREHSAFGDRPEKRDNNWRYDPRFTGSFDDDPDPHRDPYGEEVDRRSVHSEHSARSLHSAHSLASRRSSLSSHSHQSQIYRSHNVAAGSYEAPLPPGSFHGDFAYGTYRSNFSSGPGFPEYGYPADTVWPAMEQVSSRPTSPEKFSVPHVCARFGPGGQLIKVIPNLPSEGQPALVEVHSMEALLQHTSEQEEMRAFPGPLAKDDTHKVDVINFAQNKAMKCLQNENLIDKESASLLWNFIVLLCRQNGTVVGTDIAELLLRDHRTVWLPGKSPNEANLIDFTNEAVEQVEEEESGEAQLSFLTGGPAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPVSSVRPQGRSGRNDGLLALSSPDAEEPQLPDGTGREGPAAARGLANPEPAPEPKAPGDLPAAGGPPSGAMPFYNPAQLAQACATSGSSRLGRIGQRKHLVLN

SEQ ID NO: 11776 - protein, 751 aa, Homo Sapiens
PAAAASSLERETERFRELLLYGRKKDALESAMKNGLWGHALLLASKMDSRTHARVMTRFANSLPINDPLQTVYQLMSGRMPAASTCCGDEKWGDWRPHLAMVLSNLNNNMDVESRTMATMGDTLASRGLLDAAHFCYLMAQAGFGVYTKKTTKLVLIGSNHSLPFLKFATNEAIQRTEAYEYAQSLGAETCPLPSFQVFKFIYSCRLAEMGLATQAFHYCEAIAKSILTQPHLYSPVLISQLVQMASQLRLFDPQLKEKPEEESLAAPTWLVHLQQVERQIKEGAGVWHQDGALPQQCPGTPSSEMEQLDRPGLSQPGALGIANPLLAVPAPSPEHSSPSVRLLPSAPQTLPDGPLASPARVPMFPVPLPPGPLEPGPGCVTPGPALGFLEPSGPGLPPGVPPLQERRHLLQEARSPDPGIVPQEAPVGNSLSELSEENFDGKFANLTPSRTVPDSEAPPGWDRADSGPTQPPLSLSPAPETKRPGQAAKKETKEPKKGESWFFRWLPGKKKTEAYLPDDKNKSIVWDEKKNQWVNLNEPEEEKKAPPPPPTSMPKTVQAAPPALPGPPGAPVNMYSRRAAGTRARYVDVLNPSGTQRSEPALAPADFVAPLAPLPIPSNLFVPTPDAEEPQLPDGTGREGPAAARGLANPEPAPEPKVLSSAASLPGSELPSSRPEGSQGGELSRCSSMSSLSREVSQHFNQAPGDLPAAGGPPSGAMPFYNPAQLAQACATSGSSRLGRIGQRKHLVLN

SEQ ID NO: 11777 - protein, 1060 aa, Homo Sapiens
MELWAPQRLPQTRGKATAPSKDPDRGFRRDGHHRPVPHSWHNGERFHQWQDNRGSPQPQQEPRADHQQQPHYASRPGDWHQPVSGVDYYEGGYRNQLYSRPGYENSYQSYQSPTMREEYAYGSYYYHGHPQWLQEERVPRQRSPYIWHEDYREQKYLDEHHYENQHSPFGTNSETHFQSNSRNPCKDSPASNSGQEWPGELFPGSLLAEAQKNKPSLASESNLLQQRESGLSSSSYELSQYIRDAPERDDPPASAAWSPVQADVSSAGPKAPMKFYIPHVPVSFGPGGQLVHVGPSSPTDGQAALVELHSMEVILNDSEEQEEMRSFSGPLIREDVHKVDIMTFCQQKAAQSCKSETLGSRDSALLWQLLVLLCRQNGSMVGSDIAELLMQDCKKLEKYKRQPPVANLINLTDEDWPVLSSGTPNLLTGEIPPSVETPAQIVEKFTRLLYYGRKKEALEWAMKNHLWGHALFLSSKMDPQTYSWVMSGFTSTLALNDPLQTLFQLMSGRIPQAATCCGEKQWGDWRPHLAVILSNQAGDPELYQRAIVAIGDTLAGKGLVEAAHFCYLMAHVPFGHYTVKTDHLVLLGSSHSQEFLKFATTEAIQRTEIFEYCQMLGRPKSFIPSFQVYKLLYASRLADYGLVSQALHYCEAIGAAVLSQGESSHPVLLVELIKLAEKLKLSDPLVLERRSGDRDLEPDWLAQLRRQLEQKVAGDIGDPHPTRSDISGAGGTTTENTFYQDFSGCQGYSEAPGYRSALWLTPEQTCLLQPSPQQPFPLQPGSYPAGGGAGQTGTPRPFYSVPETHLPGTGSSVAVTEATGGTVWEEMLQTHLGPGENTVSQETSQPPDGQEVISKPQTPLAARPRSISESSASSAKEDEKESSDEADKNSPRNTAQRGKLGDGKEHTKSSGFGWFSWFRSKPTKNASPAGDEDSSDSPDSEETPRASSPHQAGLGLSLTPSPESPPLPDVSAFSRGRGGGEGRGSASSGGAAAGAGVGGLSGPESVSFELCSNPGVLLPPPALKGAVPLYNPSQVPQLPTATSLNRPNRLAQRRYPTQPC

SEQ ID NO: 11778 - protein, 625 aa, Homo Sapiens
MELWAPQRLPQTRGKATAPSKDPDRGFRRDGHHRPVPHSWHNGERFHQWQDNRGSPQPQQEPRADHQQQPHYASRPGDWHQPVSGVDYYEGGYRNQLYSRPGYENSYQSYQSPTMREEYAYGSYYYHGHPQWLQEERVPRQRSPYIWHEDYREQKYLDEHHYENQHSPFGTNSETHFQSNSRNPCKDSPASNSGQEWPGELFPGSLLAEAQKNKPSLASESNLLQQRESGLSSSSYELSQYIRDAPERDDPPASAAWSPVQAEDVSSAGPKAPMKFYIPHVPVSFGPGGQLVHVGPSSPTDGQAALVELHSMEVILNDSEEQEEMRSFSGPLIREDVHKVDIMTFCQQKAAQSCKSETLGSRDSALLWQLLVLLCRQNGSMVGSDIAELLMQDCKKLEKYKRQPPVANLINLTDEDWPVLSSGTPNLLTGEIPPSVETPAQIVEKFTRLLYYGRKKEALEWAMKNHLWGHALFLSSKMDPQTYSWVMSGFTSTLALNDPLQTLFQLMSGRIPQAATCCGEKQWGDWRPHLAVILSNQAGDPELYQRAIVAIGDTLAGKGLVEAAHFCYLMAHVPFGHYTVKTDHLVLLGSSHRYATWEKGNSKDIFQGTVLALVGFYGSIFHFLM

SEQ ID NO: 11779 - protein, 316 aa, Homo Sapiens
MELWAPQRLPQTRGKATAPSKDPDRGFRRDGHHRPVPHSWHNGERFHQWQDNRGSPQPQQEPRADHQQQPHYASRPGDWHQPVSGVDYYEGGYRNQLYSRPGYENSYQSYQSPTMREEYAYGSYYYHGHPQWLQEERVPRQRSPYIWHEDYREQKYLDEHHYENQHSPFGTNSETHFQSNSRNPCKDSPASNSGQEWPGELFPGSLLAEAQKNKPSLASESNLLQQRESGLSSSSYELSQYIRDAPERDDPPASAAWSPVQADVSSAGPKAPMKFYIPHVPVSFGPGGQLVHVGPSSPTDGQAALVELHSMEGRCT

SEQ ID NO: 11780 - protein, 175 aa, Homo Sapiens
  misc_feature (1)..(1): Xaa can be any naturally occurring amino acid
XLGSRDSALLWQLLVLLCRQNGSMVGSDIAELLMQDCKKLEKYKRQPPVANLINLTDEDWPVLSSGTPNLLTGEIPPSVETPAQIVEKFTRLLYYGRKKCCGEKQWGDWRPHLAVILSNQAGDPELYQRAIVAIGDTLAGKGLVEAAHFCYLMAHVPFGHYTVKTDHLVLLGSSH

SEQ ID NO: 11781 - protein, 107 aa, Homo Sapiens
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLAS

SEQ ID NO: 11782 - protein, 142 aa, Homo Sapiens
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQ

SEQ ID NO: 11783 - protein, 228 aa, Homo Sapiens
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQDPRSWFCWLDQTS

SEQ ID NO: 11784 - protein, 236 aa, Homo Sapiens
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIF

SEQ ID NO: 11785 - protein, 303 aa, Homo Sapiens
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQCYLYLFYSPARTMKVVLMLLFICLGNMYLHGLRNLWQILFHIGVAFLSSYQILTRQLQEKQSDCGV

SEQ ID NO: 11786 - protein, 250 aa, Homo Sapiens
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQDPRSWFCWLDQTS

SEQ ID NO: 11787 - protein, 250 aa, Homo Sapiens; identical to SEQ ID NO: 11786

SEQ ID NO: 11788 - protein, 61 aa, Homo Sapiens
MSVIFFACVVRVRDGLPLSASTDFYHTQDFLEWRRRLKSLALRLAQYPGRGSAEGCDFSIQ

SEQ ID NO: 11789 - protein, 72 aa, Homo Sapiens
MSVIFFACVVRVRDGLPLSASTDFYHTQDFLEWRRRLKSLALRLAQYPGRGSAEGCDFSIQDKVLPCCPGWS

SEQ ID NO: 11790 - protein, 72 aa, Homo Sapiens; identical to SEQ ID NO: 11789

SEQ ID NO: 11791 - protein, 143 aa, Homo Sapiens
MSVIFFACVVRVRDGLPLSASTDFYHTQDFLEWRRRLKSLALRLAQYPGRGSAEGCDFSIQHFKGSGRKTVSGIGRTEETIYLQQTATGLFKAKQVQNSVFLLSGTWPAWLSAPASVQQPWPSASWRPCGGNSQLPMTLPALA

SEQ ID NO: 11792 - protein, 75 aa, Homo Sapiens
MSVIFFACVVRVRDGLPLSASTDFYHTQDFLEWRRRLKSLALRLAQYPGRGSAEGCDFSIQLLDILKEAEERQSQ

SEQ ID NO: 11793 - protein, 225 aa, Homo Sapiens
  misc_feature (1)..(1): Xaa can be any naturally occurring amino acid
XAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQCYLYLFYSPARTMKVVLMLLFICLGNMYLHGLRNLWQILFHIGVAFLSSYQILTRQLQEKQSDCGV

SEQ ID NO: 11794 - protein, 286 aa, Homo Sapiens
FGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNV

SEQ ID NO: 11795 - protein, 11 aa, Homo Sapiens
MKLKEVDRTAM

SEQ ID NO: 11796 - protein, 27 aa, Homo Sapiens
MKLKEVDRTAMQAWSPAQNHPIYLATG

SEQ ID NO: 11797 - protein, 65 aa, Homo Sapiens
MKLKEVDRTAMQAWSPAQNHPIYLATGTSAQQLDATFSTNASLEIFELDLSDPSLDMKSCATFSS

SEQ ID NO: 11798 - protein, 66 aa, Homo Sapiens
MKLKEVDRTAMQAWSPAQNHPIYLATGTSAQQLDATFSTNASLEIFELDLSDPSLDMKSCATFSSS

SEQ ID NO: 11799 - protein, 81 aa, Homo Sapiens
MKLKEVDRTAMQAWSPAQNHPIYLATGTSAQQLDATFSTNASLEIFELDLSDPSLDMKSCATFSSSHRYHKLIWGPYKMDS

SEQ ID NO: 11800 - protein, 92 aa, Homo Sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAD

SEQ ID NO: 11801 - protein, 165 aa, Homo Sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKT

SEQ ID NO: 11802 - protein, 166 aa, Homo Sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQ

SEQ ID NO: 11803 - protein, 1106 aa, Homo Sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQRPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 11804 - protein, 1181 aa, Homo Sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 11805 - protein, 1220 aa, Homo Sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 11806 - protein, 1220 aa, Homo Sapiens; identical to SEQ ID NO: 11805

SEQ ID NO: 11807 - protein, 1220 aa, Homo Sapiens; identical to SEQ ID NO: 11805

SEQ ID NO: 11808 - protein, 1251 aa, Homo Sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHVRIAPTVTTWSNKTPTALPSHPPAASPSDTQGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 11809 - protein, 1067 aa, Homo Sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQRPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 11810 - protein, 1106 aa, Homo Sapiens; identical to SEQ ID NO: 11803

SEQ ID NO: 11811 - protein, 1067 aa, Homo Sapiens; identical to SEQ ID NO: 11809

SEQ ID NO: 11812 - protein, 1166 aa, Homo Sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 11813 - protein, 1205 aa, Homo Sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 11814 - protein, 877 aa, Homo Sapiens
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQRK

SEQ ID NO: 11815 - protein, 68 aa, Homo Sapiens
MKLKEVDRTAMQAWSPAQNHPIYLATGTSAQQLDATFSTNASLEIFELDLSDPSLDMKSCATFSSSHS

SEQ ID NO: 11816 - protein, 1200 aa, Homo Sapiens
MLGESDERCTNAGSGCRRSSPGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 11817 - protein, 969 aa, Homo Sapiens
MVKLVLLSIVLLKVTVPKLSNDLLQLDFMPIHRGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHVRIAPTVTTWSNKTPTALPSHPPAASPSDTQGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 11818 - protein, 235 aa, Homo Sapiens
TQDPAAEGPRQQDEVKGSRSYSHAGMEPCPESPHLPSNRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARYRA

SEQ ID NO: 11819 - protein, 237 aa, Homo Sapiens
  misc_feature (1)..(1): Xaa can be any naturally occurring amino acid
XAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCGNVEKLVACWTKAQDGSHPLSLQDLIEKVVILRKAVQLTQAMDTSTVGVLLAA

SEQ ID NO: 11820 - protein, 443 aa, Homo Sapiens
  misc_feature (1)..(1): Xaa can be any naturally occurring amino acid
XFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRV

SEQ ID NO: 11821 - protein, 383 aa, Homo Sapiens
  misc_feature (1)..(1): Xaa can be any naturally occurring amino acid
XNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTENQSIQDQAPMLEGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 11822 - protein, 181 aa, Homo Sapiens
  misc_feature (1)..(1): Xaa can be any naturally occurring amino acid
XPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPLSPTITSGLHNIARSIETRNYSEGLTMHTHIVSTSNFSETSAFMPVLKVVLTQANKLGV

SEQ ID NO: 11823 - protein, 219 aa, Homo Sapiens
  misc_feature (1)..(1): Xaa can be any naturally occurring amino acid
XQMPRVQTQQYYPHVRIAPTVTTWSNKTPTALPSHPPAASPSDTQGENPPPPGFIMHGNVNPNAAGQLPTSPGHMHTQVPPYPQPQRPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTT

SEQ ID NO: 11824 - protein, 275 aa, Homo Sapiens
GTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVS

SEQ ID NO: 11825 - protein, 786 aa, Homo Sapiens
MAFGASTFPPQYLSSEITLHPYAYSPYTLDSTQNVYSVPGSQYLYNQPSCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 11826 - protein, 854 aa, Homo Sapiens
MASEGPREPESEGIKLSADVKPFVPRFAGLNVAWLESSEACVFPSSAATYYPFVQEPPVTEQKIYTEDMAFGASTFPPQYLSSEITLHPYAYSPYTLDSTQNVYSVPGSQYLYNQPSCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 11827 - protein, 60 aa, Homo Sapiens
MPLPILLHVQEQILKMLVYHLLKLYLRILPTTKKNTLFILPKSLKHHKVVTLNKMKPQER

SEQ ID NO: 11828 - protein, 781 aa, Homo Sapiens
MVRVLRSMCLPQLCSHILSVCSGTTSDRNVYSVPGSQYLYNQPSCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 11829 - protein, 43 aa, Homo Sapiens
MQTCPLAFPGHVSQALGTLLFLAASLSAQNEAACPRAGERHLQ

SEQ ID NO: 11830 - protein, 44 aa, Homo Sapiens
MQTCPLAFPGHVSQALGTLLFLAASLSAQNEGWDSPICTEGVVS

SEQ ID NO: 11831 - protein, 85 aa, Homo Sapiens
MQTCPLAFPGHVSQALGTLLFLAASLSAQNEGWDSPICTEGVVSVSWGENTVMSCNISNAFSHVNIKLRAHGQESAIFNEVAPGY

SEQ ID NO: 11832 - protein, 147 aa, Homo Sapiens
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSEPRGLKDRASAQL

SEQ ID NO: 11833 - protein, 170 aa, Homo Sapiens
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSEPRGLKDRASAQLLGPGTSRGAEPQSAPDTGFWPVP

SEQ ID NO: 11834 - protein, 149 aa, Homo Sapiens
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSGAAVPSNAGRRSSSS

SEQ ID NO: 11835 - protein, 178 aa, Homo Sapiens
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSGAEPQSAPDTGFWPVPAVVTAVFILLVALVMFAWYRCRCSQQRR

SEQ ID NO: 11836 - protein, 248 aa, Homo Sapiens
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSGAEPQSAPDTGFWPVPAVVTAVFILLVALVMFAWYRCRCSQQRREKKFFLLEPQMKVAALRAGAQQGLSRASAELWTPDSEPTPRPLALVFKPSPLGALELLSPQPLFPYAADP

SEQ ID NO: 11837 - protein, 794 aa, Homo Sapiens
MRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPALTAIEGTAHGEPCHFPFLFLDKEYDECTSDGREDGRLWCATTYDYKADEKWGFCETEEEAAKRRQMQEAEMMYQTGMKILNGSNKKSQKREAYRYLQKAASMNHTKALERVSYALLFGDYLPQNIQAAREMFEKLTEEGSPKGQTALGFLYASGLGVNSSQAKALVYYTFGALGGNLIAHMVLGYRYWAGIGVLQSCESALTHYRLVANHVASDISLTGGSVVQRIRLPDEVENPGMNSGMLEEDLIQYYQFLAEKGDVQAQVGLGQLHLHGGRGVEQNHQRAFDYFNLAANAGNSHAMAFLGKMYSEGSDIVPQSNETALHYFKKAADMGNPVGQSGLGMAYLYGRGVQVNYDLALKYFQKAAEQGWVDGQLQLGSMYYNGIGVKRDYKQALKYFNLASQGGHILAFYNLAQMHASGTGVMRSCHTAVELFKNVCERGRWSERLMTAYNSYKDGDYNAAVIQYLLLAEQGYEVAQSNAAFILDQREASIVGENETYPRALLHWNRAASQGYTVARIKLGDYHFYGFGTDVDYETAFIHYRLASEQQHSAQAMFNLGYMHEKGLGIKQDIHLAKRFYDMAAEASPDAQVPVFLALCKLGVVYFLQYIRETNIRDMFTQLDMDQLLGPEWDLYLMTIIALLLGTVIAYRQRQHQDMPAPRPPGPRPAPPQQEGPPEQQPPQ

SEQ ID NO: 11838 - protein, 301 aa, Homo Sapiens
MRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPALTAIEGTAHGEPCHFPFLFLDKEYDECTSDGREDGRLWCATTYDYKADEKWGFCETEEEAAKRRQMQEAEMMYQTGMKILNGSNKKSQKREAYRYLQKAASMNHTKALERVSYALLFGDYLPQNIQAAREMFEKLTEEGSPKGQTALGFLYASGLGVNSSQAKALVYYTFGALGGNLIAHMVLVSRL

SEQ ID NO: 11839 - protein, 163 aa, Homo Sapiens
MRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPDKEYDECTSDGREDGRLWCATTYDYKADEKWGFCETEEEAAKRRQMQEAE

SEQ ID NO: 11840 - protein, 88 aa, Homo Sapiens
FNLLQLDPDCRGCCQEEAQFETKKYSSIVSKQECHHSNCMQELFLKFVDENWEGSLKSKYVRGSDPVLKLLDDNGNIAEELSILKWNT

SEQ ID NO: 11841 - protein, 164 aa, Homo Sapiens
MVAMAAGPSGCLVPAFGLRLLLATVLQAVSAFGAEFSSEACRELGFSSNLLCSSCDLLGQFNLLQLDPDCRGCCQEEAQFETKKLYAGAILEVCGKLGRFPQVQAFVRSDKPKLFRGLQIKYVRGSDPVLKLLDDNGNIAEELSILKWNTDSVEEFLSEKLERI

SEQ ID NO: 11842 - protein, 123 aa, Homo Sapiens
MVAMAAGPSGCLVPAFGLRLLLATVLQAVSAFGAEFSSEACRELGFSSNLLCSSCDLLGQFNLLQLDPDCRGCCQEEAQFETKKLYAGAILEVCGKLGRFPQVQVCPWFRPCIKAFGRQWEHC

SEQ ID NO: 11843 - protein, 164 aa, Homo Sapiens; identical to SEQ ID NO: 11841

SEQ ID NO: 11844 - protein, 123 aa, Homo Sapiens; identical to SEQ ID NO: 11842

SEQ ID NO: 11845 - protein, 144 aa, Homo Sapiens
MVAMAAGPSGCLVPAFGLRLLLATVLQAVSAFGAEFSSEACRELGFSSNLLCSSCDLLGQFNLLQLDPDCRGCCQEEAQFETKKYSSIVSKQECHHSNCMQELFLKFVDENWEGSLKSKLLLGVINPNCSEDCKSSMSVVQTLY

SEQ ID NO: 11846 - protein, 31 aa, Homo Sapiens
  misc_feature (1)..(1): Xaa can be any naturally occurring amino acid
XGLRLLLATVLQAVSVDHLRSCHRESRSDCS

SEQ ID NO: 11847 - protein, 144 aa, Homo Sapiens
MSLLLPPLALLLLLAALVAPATAATAYRPDWNRLSGLTRARVETCGGQLNRLKEVKAFVTQDIPFYHNLVMKHLPGADPELVLLGRRYEELERIPLSEMTREEINALVQELGFYRKAAPDAQVPPEYVWAPAKPPEETSDHADL

SEQ ID NO: 11848 - protein, 144 aa, Homo Sapiens; identical to SEQ ID NO: 11847

SEQ ID NO: 11849 - protein, 144 aa, Homo Sapiens; identical to SEQ ID NO: 11847

SEQ ID NO: 11850 - protein, 588 aa, Homo Sapiens
MGRARPGQRGPPSPGPAAQPPAPPRRRARSLALLGALLAAAAAAAVRVCARHAEAQAAARQELALKTLGTDGLFLFSSLDTDGDMYISPEEFKPIAEKLTGSCSVTQTGVQWCSHSSLQPQLPWLNSSCLSLLRSTPAASCEEEELPPDPSEETLTIEARFQPLLPETMTKSKDGFLGVSRLALSGLRNWTAAASPSAVFATRHFQPFLPPPGQELGEPWWIIPSELSMFTGYLSNNRFYPPPPKGKEVIIHRLLSMFHPRPFVKTRFAPQGAVACLTAISDFYYTVMFRIHAEFQLSEPPDFPFWFSPAQFTGHIILSKDATHVRDFRLFVPNHRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSCGSGRTLRETVLESSPILTLLNESFISTWSLVKELEELQNNQENSSHQKLAGLHLEKYSFPVEMMICLPNGTVVHHINANYFLDITSVKPEEIESNLFSFSSTFEDPSTATYMQFLKEGLRRGLPLLQP

SEQ ID NO: 11851 - protein, 555 aa, Homo Sapiens
MGRARPGQRGPPSPGPAAQPPAPPRRRARSLALLGALLAAAAAAAVRVCARHAEAQAAARQELALKTLGTDGLFLFSSLDTDGDMYISPEEFKPIAEKLTGSTPAASCEEEELPPDPSEETLTIEARFQPLLPETMTKSKDGFLGVSRLALSGLRNWTAAASPSAVFATRHFQPFLPPPGQELGEPWWIIPSELSMFTGYLSNNRFYPPPPKGKEVIIHRLLSMFHPRPFVKTRFAPQGAVACLTAISDFYYTVMFRIHAEFQLSEPPDFPFWFSPAQFTGHIILSKDATHVRDFRLFVPNHRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSCGSGRTLRETVLESSPILTLLNESFISTWSLVKELEELQNNQENSSHQKLAGLHLEKYSFPVEMMICLPNGTVVHHINANYFLDITSVKPEEIESNLFSFSSTFEDPSTATYMQFLKEGLRRGLPLLQP

SEQ ID NO: 11852 - protein, 556 aa, Homo Sapiens
MGRARPGQRGPPSPGPAAQPPAPPRRRARSLALLGALLAAAAAAAVRVCARHAEAQAAARQELALKTLGTDGLFLFSSLDTDGDMYISPEEFKPIAEKLTGSTPAASCEEEELPPDPSEETLTIEARFQPLLPETMTKSKDGFLGVSRLALSGLRNWTAAASPSAVFATRHFQPFLPPPGQELGEPWWIIPSELSMFTGYLSNNRFYPPPPKGKEVIIHRLLSMFHPRPFVKTRFAPQGAVACLTAISDFYYTVMFRIHAEFQLSEPPDFPFWFSPAQFTGHIILSKDATHVRDFRLFVPNHRSLNVDMEWLYGASESSNMEVDIGYIPQMELEATGPSVPSVILDEDGSMIDSHLPSGEPLQFVFEEIKWQQELSWEEAARRLEVAMYPFKKVSYLPFTEAFDRAKAENKLVHSILLWGALDDQSCHCSGRTLRETVLESSPILTLLNESFISTWSLVKELEELQNNQENSSHQKLAGLHLEKYSFPVEMMICLPNGTVVHHINANYFLDITSVKPEEIESNLFSFSSTFEDPSTATYMQFLKEGLRRGLPLLQP

SEQ ID NO: 11853 - protein, 66 aa, Homo Sapiens
MMICLPNGTVVHHINANYFLDITSVKPEEIESNLFSFSSTFEDPSTATYMQFLKEGLRRGLPLLQP

SEQ ID NO: 11854 - protein, 668 aa, Homo Sapiens
MAVYRAALGASLAAARLLPLGRCSPSPAPRSTLSGAAMEPAPRWLAGLRFDNRALRALPVEAPPPGPEGAPSAPRPVPGACFTRVQPTPLRQPRLVALSEPALALLGLGAPPAREAEAEAALFFSGNALLPGAEPAAHCYCGHQFGQFAGQLGDGAAMYLGEVCTATGERWELQLKGAGPTPFSRQADGRKVLRSSIREFLCSEAMFHLGVPTTRAGACVTSESTVVRDVFYDGNPKYEQCTVVLRVASTFIRFGSFEIFKSADEHTGRAGPSVGRNDIRVQLLDYVISSFYPEIQAAHASDSVQRNAAFFREVTRRTARMVAEWQCVGFCHGVLNTDNMSILGLTIDYGPFGFLDRYDPDHVCNASDNTGRYAYSKQPEVCRWNLRKLAEALQPELPLELGEAILAEEFDAEFQRHYLQKMRRKLGLVQVELEEDGALVSKLLETMHLTGADFTNTFYLLSSFPVELESPGLAEFLARLMEQCASLEELRLAFRPQMDPRQLSMMLMLAQSNPQLFALMGTRAGIARELERVEQQSRLEQLSAAELQSRNQGHWADWLQAYRARLDKDLEGAGDAAAWQAEHVRVMHANNPKYVLRNYIAQNAIEAAERGDFSEVRRVLKLLETPYHCEAGAATDAEATEADGADGRQRSYSSKPPLWAAELCVTSS

SEQ ID NO: 11855 - protein, 668 aa, Homo Sapiens; identical to SEQ ID NO: 11854

SEQ ID NO: 11856 - protein, 208 aa, Homo Sapiens
MWRSLGLALALCLLPSGGTESQDQSSLCKQPPAWSIRDQDPMLNSNGSVTVVALLQASYLCILQASKLEDLRVKLKKEGYSNISYIVVNHQGISSRLKYTHLKNKVSEHIPVYQQEENQTDVWTLLNGSKDDFLIYDRCGRLVYHLGLPFSFLTFPYVEEAIKIAYCEKKCGNCSLTTLKDEDFCKRVSLATVDKTVETPSPHYHHEH

SEQ ID NO: 11857 - protein, 371 aa, Homo Sapiens
MWRSLGLALALCLLPSGGTESQDQSSLCKQPPAWSIRDQDPMLNSNGSVTVVALLQASYLCILQASKLEDLRVKLKKEGYSNISYIVVNHQGISSRLKYTHLKNKVSEHIPVYQQEENQTDVWTLLNGSKDDFLIYDRCGRLVYHLGLPFSFLTFPYVEEAIKIAYCEKKCGNCSLTTLKDEDFCKRVSLATVDKTVETPSPHYHHEHHHNHGHQHLGSSELSENQQPGAPNAPTHPAPPGLHHHHKHKGQHRQGHPENRDMPASEDLQDLQKKLCRKRCINQLLCKLPTDSELAPRSCCHCRHLIFEKTGSAITQCKENLPSLCSQGLRAEENITESCQRLPPAAQISQQLIPTEASASRKNQAKKEPSN

SEQ ID NO: 11858 - protein, 371 aa, Homo Sapiens; identical to SEQ ID NO: 11857

SEQ ID NO: 11859 - protein, 371 aa, Homo Sapiens; identical to SEQ ID NO: 11857

SEQ ID NO: 11860 - protein, 308 aa, Homo Sapiens
MWRSLGLALALCLLPSGGTESQDQSSLCKQPPAWSIRDQDPMLNSNGSVTVVALLQASYLCILQASKLEDLRVKLKKEGYSNISYIVVNHQGISSRLKYTHLKNKVSEHIPVYQQEENQTDVWTLLNGSKDDFLIYDRCGRLVYHLGLPFSFLTFPYVEEAIKIAYCEKKCGNCSLTTLKDEDFCKRVSLATVDKTVETPSPHYHHEHHHNHGHQHLGSSELSENQQPGAPNAPTHPAPPGLHHHHKHKGQHRQGHPENRDMPASEDLQDLQKKLCRKRCINQLLCKLPTDSELAPRSCCHCRHLIFE

SEQ ID NO: 11861 - protein, 170 aa, Homo Sapiens
MWRSLGLALALCLLPSGGTESQDQSSLCKQPPAWSIRDQDPMLNSNGSVTVVALLQASYLCILQASKLSKMKTFVNVYLWLLWIKQLKLHRLITIMSIITIMDISTLAAVSFQRISNQEHQMLLLILLLQAFITTISTRVSIGRVTQRTEICQQVKIYKIYKRSSVERDV

SEQ ID NO: 11862 - protein, 19 aa, Homo Sapiens
MGWLTRIVCLFWGVLLTAR

SEQ ID NO: 11863 - protein, 37 aa, Homo Sapiens
MGWLTRIVCLFWGVLLTARANYQNGKNNVPRLKLSYK

SEQ ID NO: 11864 - protein, 149 aa, Homo Sapiens
MGWLTRIVCLFWGVLLTARANYQNGKNNVPRLKLSYKEMLESNNVITFNGLANSSSYHTFLLDEERSRLYVGAKDHIFSFDLVNIKDFQKIVWPVSYTRRDECKWAGKDILKECANFIKVLKAYNQTHLYACGTGAFHPICTYIEIGHH

SEQ ID NO: 11865 - protein, 771 aa, Homo Sapiens [sequence omitted]

SEQ ID NO: 11866 - protein, 771 aa, Homo Sapiens [sequence omitted]

SEQ ID NO: 11867 - protein, 214 aa, Homo Sapiens
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEP

SEQ ID NO: 11868 - protein, 748 aa, Homo Sapiens
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 11869 - protein, 754 aa, Homo Sapiens
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLRPFPAEDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 11870 - protein, 749 aa, Homo Sapiens
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 11871 - protein, 749 aa, Homo Sapiens; identical to SEQ ID NO: 11870

SEQ ID NO: 11872 - protein, 406 aa, Homo Sapiens
MNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 11873 - protein, 406 aa, Homo Sapiens; identical to SEQ ID NO: 11872

SEQ ID NO: 11874 - protein, 751 aa, Homo Sapiens
MAFRTICVLVGVFICSICVKGSSQPQARVYLTFDELRETKTSEYFSLSHHPLDYRILLMDEDQDRIYVGSKDHILSLNINNISQEALSVFWPASTIKVEECKMAGKDPTHGCGNFVRVIQTFNRTHLYVCGSGAFSPVCTYLNRGRRSEDQVFMIDSKCESGKGRCSFNPNVNTVSVMINEELFSGMYIDFMGTDAAIFRSLTKRNAVRTDQHNSKWLSEPMFVDAHVIPDGTDPNDAKVYFFFKEKLTDNNRSTKQIHSMIARICPNDTGGLRSLVNKWTTFLKARLVCSVTDEDGPETHFDELEDVFLLETDNPRTTLVYGIFTTSSSVFKGSAVCVYHLSDIQTVFNGPFAHKEGPNHQLISYQGRIPYPRPGTCPGGAFTPNMRTTKEFPDDVVTFIRNHPLMYNSIYPIHKRPLIVRIGTDYKYTKIAVDRVNAADGRYHVLFLGTDRGTVQKVVVLPTNNSVSGELILEELEVFKNHAPITTMKISSKKQQLYVSSNEGVSQVSLHRCHIYGTACADCCLARDPYCAWDGHSCSRFYPTGKRRSRRQDVRHGNPLTQCRGFNLKAYRNAAEIVQYGVKNNTTFLECAPKSPQASIKWLLQKDKDRRKEVKLNERIIATSQGLLIRSVQGSDQGLYHCIATENSFKQTIAKINFKVLDSEMVAVVTDKWSPWTWASSVRALPFHPKDIMGAFSHSEMQMINQYCKDTRQQHQQGDESQKMRGDYGKLKALINSRKSRNRRNQLPES

SEQ ID NO: 11875 - protein, 751 aa, Homo Sapiens; identical to SEQ ID NO: 11874

SEQ ID NO: 11876 - protein, 63 aa, Homo Sapiens
MAFRTICVLVGVFICSICVKGSSQPQARVYLTFDEPTLYNAVCYICGYKKKCGVNLVLSNHLL

SEQ ID NO: 11877 - protein, 63 aa, Homo Sapiens; identical to SEQ ID NO: 11876

SEQ ID NO: 11878 - protein, 40 aa, Homo Sapiens
MAFRTICVLVGVFICSICVKGSSQPQARVYLTFDGPSFHD

SEQ ID NO: 11879 - protein, 39 aa, Homo Sapiens
MASAGHIITLLLWGYLLELWTGGHTADTTHPRLRLSHKE

SEQ ID NO: 11880 - protein, 775 aa, Homo Sapiens
MASAGHIITLLLWGYLLELWTGGHTADTTHPRLRLSHKELLNLNRTSIFHSPFGFLDLHTMLLDEYQERLFVGGRDLVYSLSLERISDGYKEIHWPSTALKMEECIMKGKDAGECANYVRVLHHYNRTHLLTCGTGAFDPVCAFIRVGYHLEDPLFHLESPRSERGRGRCPFDPSSSFISTLIGSELFAGLYSDYWSRDAAIFRSMGRLAHIRTEHDDERLLKEPKFVGSYMIPDNEDRDDNKVYFFFTEKALEAENNAHAIYTRVGRLCVNDVGGQRILVNKWSTFLKARLVCSVPGMNGIDTYFDELEDVFLLPTRDHKNPVIFGLFNTTSNIFRGHAICVYHMSSIRAAFNGPYAHKEGPEYHWSVYEGKVPYPRPGSCASKVNGGRYGTTKDYPDDAIRFARSHPLMYQAIKPAHKKPILVKTDGKYNLKQIAVDRVEAEDGQYDVLFIGTDNGIVLKVITIYNQEMESMEEVILEELQIFKDPVPIISMEISSKRQQLYIGSASAVAQVRFHHCDMYGSACADCCLARDPYCAWDGISCSRYYPTGTHAKRRFRRQDVRHGNAAQQCFGQQFVGDALDKTEEHLAYGIENNSTLLECTPRSLQAKVIWFVQKGRETRKEEVKTDDRVVKMDLGLLFLRLHKSDAGTYFCQTVEHSFVHTVRKITLEVVEEEKVEDMFNKDDEEDRHHRMPCPAQSSISQGAKPWYKEFLQLIGYSNFQRVEEYCEKVWCTDRKRKKLKMSPSKWKYANPQEKKLRSKPEHYRLPRHTLDS

SEQ ID NO: 11881 - protein, 630 aa, Homo Sapiens
MASAGHIITLLLWGYLLELWTGGHTADTTHPRLRLSHKELLNLNRTSIFHSPFGFLDLHTMLLDEYQERLFVGGRDLVYSLSLERISDGYKEIHWPSTALKMEECIMKGKDAGECANYVRVLHHYNRTHLLTCGTGAFDPVCAFIRVGYHLEDPLFHLESPRSERGRGRCPFDPSSSFISTLIGSELFAGLYSDYWSRDAAIFRSMGRLAHIRTEHDDERLLKEPKFVGSYMIPDNEDRDDNKVYFFFTEKALEAENNAHAIYTRVGRLCVNDVGGQRILVNKWSTFLKARLVCSVPGMNGIDTYFDELEDVFLLPTRDHKNPVIFGLFNTTSNIFRGHAICVYHMSSIRAAFNGPYAHKEGPEYHWSVYEGKVPYPRPGSCASKVNGGRYGTTKDYPDDAIRFARSHPLMYQAIKPAHKKPILVKTDGKYNLKQIAVDRVEAEDGQYDVLFIGTDNGIVLKVITIYNQEMESMEEVILEELQIFKDPVPIISMEISSKRQQLYIGSASAVAQVRFHHCDMYGSACADCCLARDPYCAWDGISCSRYYPTGTHAKRRFRRQDVRHGNAAQQCFGQQFVGDALDKTEEHLAYGIENNSTLLECTPRSLQAKVIWFVQKGRETRKEEVKAMS

SEQ ID NO: 11882 - protein, 775 aa, Homo Sapiens; identical to SEQ ID NO: 11880

SEQ ID NO: 11883 - protein, 715 aa, Homo Sapiens
MLLDEYQERLFVGGRDLVYSLSLERISDGYKEIHWPSTALKMEECIMKGKDAGECANYVRVLHHYNRTHLLTCGTGAFDPVCAFIRVGYHLEDPLFHLESPRSERGRGRCPFDPSSSFISTLIGSELFAGLYSDYWSRDAAIFRSMGRLAHIRTEHDDERLLKEPKFVGSYMIPDNEDRDDNKVYFFFTEKALEAENNAHAIYTRVGRLCVNDVGGQRILVNKWSTFLKARLVCSVPGMNGIDTYFDELEDVFLLPTRDHKNPVIFGLFNTTSNIFRGHAICVYHMSSIRAAFNGPYAHKEGPEYHWSVYEGKVPYPRPGSCASKVNGGRYGTTKDYPDDAIRFARSHPLMYQAIKPAHKKPILVKTDGKYNLKQIAVDRVEAEDGQYDVLFIGTDNGIVLKVITIYNQEMESMEEVILEELQIFKDPVPIISMEISSKRQQLYIGSASAVAQVRFHHCDMYGSACADCCLARDPYCAWDGISCSRYYPTGTHAKRRFRRQDVRHGNAAQQCFGQQFVGDALDKTEEHLAYGIENNSTLLECTPRSLQAKVIWFVQKGRETRKEEVKTDDRVVKMDLGLLFLRLHKSDAGTYFCQTVEHSFVHTVRKITLEVVEEEKVEDMFNKDDEEDRHHRMPCPAQSSISQGAKPWYKEFLQLIGYSNFQRVEEYCEKVWCTDRKRKKLKMSPSKWKYANPQEKKLRSKPEHYRLPRHTLDS

SEQ ID NO: 11884 - protein, 147 aa, Homo Sapiens
GTAHFFNFLLNTTDYRILLKDEDHDRMYVGSKDYVLSLDLHDINREPLIIHWAASPQRIEECVLSGKDVNPSLWPQGECGNFVRLIQPWNRTHLYVCGTGAYNPMCTYVNRGRRAQDYIFYLEPERLESGKGKCPYDPKLDTASALI

SEQ ID NO: 11885 - protein, 785 aa, Homo Sapiens
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQATPWTQTQAVRGRGSRATDGALRPMPTAPRQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYARIGRICLNDDGGHCCLVNKWSTFLKARLVCSVPGEDGIETHFDELQDVFVQQTQDVRNPVIYAVFTSSGSVFRGSAVCVYSMADIRMVFNGPFAHKEGPNYQWMPFSGKMPYPRPGTCPGGTFTPSMKSTKDYPDEVINFMRSHPLMYQAVYPLQRRPLVVRTGAPYRLTTIAVDQVDAADGRYEVLFLGTDRGTVQKVIVLPKDDQELEELMLEEVEVFKDPAPVKTMTISSKRQQLYVASAVGVTHLSLHRCQAYGAACADCCLARDPYCAWDGQACSRYTASSKRRSRRQDVRHGNPIRQCRGFNSNANKNAVESVQYGVAGSAAFLECQPRSPQATVKWLFQRDPGDRRREIRAEDRFLRTEQGLLLRALQLSDRGLYSCTATENNFKHVVTRVQLHVLGRDAVHAALFPPLSMSAPPPPGAGPPTPPYQELAQLLAQPEVGLIHQYCQGYWRHVPPSPREAPGAPRSPEPQDQKKPRNRRHHPPDT

SEQ ID NO: 11886 - protein, 264 aa, Homo Sapiens
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYAR

SEQ ID NO: 11887 - protein, 754 aa, Homo Sapiens
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYARIGRICLNDDGGHCCLVNKWSTFLKARLVCSVPGEDGIETHFDELQDVFVQQTQDVRNPVIYAVFTSSGSVFRGSAVCVYSMADIRMVFNGPFAHKEGPNYQWMPFSGKMPYPRPGTCPGGTFTPSMKSTKDYPDEVINFMRSHPLMYQAVYPLQRRPLVVRTGAPYRLTTIAVDQVDAADGRYEVLFLGTDRGTVQKVIVLPKDDQELEELMLEEVEVFKDPAPVKTMTISSKRQQLYVASAVGVTHLSLHRCQAYGAACADCCLARDPYCAWDGQACSRYTASSKRRSRRQDVRHGNPIRQCRGFNSNANKNAVESVQYGVAGSAAFLECQPRSPQATVKWLFQRDPGDRRREIRAEDRFLRTEQGLLLRALQLSDRGLYSCTATENNFKHVVTRVQLHVLGRDAVHAALFPPLSMSAPPPPGAGPPTPPYQELAQLLAQPEVGLIHQYCQGYWRHVPPSPREAPGAPRSPEPQDQKKPRNRRHHPPDT

SEQ ID NO: 11888 - protein, 380 aa, Homo Sapiens
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYARIGRICLNDDGGHCCLVNKWSTFLKARLVCSVPGEDGIETHFDELQDVFVQQTQDVRNPVIYAVFTSSGSVFRGSAVCVYSMADIRMVFNGPFAHKEGPNYQWMPFSGKMPYPRPGT

SEQ ID NO: 11889 - protein, 92 aa, Homo Sapiens
MLVAGLLLWASLLTGAWPSFPTQDHLPATPRVRLSFKELKATGTAHFFNFLLNTTDYRILLKDEDHDRMYVGSKDYVLSLDLHDINREPLIV

SEQ ID NO: 11890 - protein, 686 aa, Homo Sapiens
MYVGSKDYVLSLDLHDINREPLIIHWAASPQRIEECVLSGKDVNGECGNFVRLIQPWNRTHLYVCGTGAYNPMCTYVNRGRRAQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYARIGRICLNDDGGHCCLVNKWSTFLKARLVCSVPGEDGIETHFDELQDVFVQQTQDVRNPVIYAVFTSSGSVFRGSAVCVYSMADIRMVFNGPFAHKEGPNYQWMPFSGKMPYPRPGTCPGGTFTPSMKSTKDYPDEVINFMRSHPLMYQAVYPLQRRPLVVRTGAPYRLTTIAVDQVDAADGRYEVLFLGTDRGTVQKVIVLPKDDQELEELMLEEVEVFKDPAPVKTMTISSKRQQLYVASAVGVTHLSLHRCQAYGAACADCCLARDPYCAWDGQACSRYTASSKRRSRRQDVRHGNPIRQCRGFNSNANKNAVESVQYGVAGSAAFLECQPRSPQATVKWLFQRDPGDRRREIRAEDRFLRTEQGLLLRALQLSDRGLYSCTATENNFKHVVTRVQLHVLGRDAVHAALFPPLSMSAPPPPGAGPPTPPYQELAQLLAQPEVGLIHQYCQGYWRHVPPSPREAPGAPRSPEPQDQKKPRNRRHHPPDT

SEQ ID NO: 11891 - protein, 782 aa, Homo Sapiens
MAPSAWAICWLLGGLLLHGGSSGPSPGPSVPRLRLSYRDLLSANRSAIFLGPQGSLNLQAMYLDEYRDRLFLGGLDALYSLRLDQAWPDPREVLWPPQPGQREECVRKGRDPLTECANFVRVLQPHNRTHLLACGTGAFQPTCALITVGHRGEHVLHLEPGSVESGRGRCPHEPSRPFASTFIDGELYTGLTADFLGREAMIFRSGGPRPALRSDSDQSLLHDPRFVMAARIPENSDQDNDKVYFFFSETVPSPDGGSNHVTVSRVGRVCVNDAGGQRVLVNKWSTFLKARLVCSVPGPGGAETHFDQLEDVFLLWPKAGKSLEVYALFSTVSAVFQGFAVCVYHMADIWEVFNGPFAHRDGPQHQWGPYGGKVPFPRPGVCPSKMTAQPGRPFGSTKDYPDEVLQFARAHPLMFWPVRPRHGRPVLVKTHLAQQLHQIVVDRVEAEDGTYDVIFLGTDSGSVLKVIALQAGGSAEPEEVVLEELQVFKVPTPITEMEISVKRQMLYVGSRLGVAQLRLHQCETYGTACAECCLARDPYCAWDGASCTHYRPSLGKRRFRRQDIRHGNPALQCLGQSQEEEAVGLVAATMVYGTEHNSTFLECLPKSPQAAVRWLLQRPGDEGPDQVKTDERVLHTERGLLFRRLSRFDAGTYTCTTLEHGFSQTVVRLALVVIVASQLDNLFPPEPKPEEPPARGGLASTPPKAWYKDILQLIGFANLPRVDEYCERVWCRGTTECSGCFRSRSRGKQARGKSWAGLELGKKMKSRVHAEHNRTPREVEAT

SEQ ID NO: 11892 - protein, 186 aa, Homo Sapiens
MAPSAWAICWLLGGLLLHGGSSGPSPGPSVPRLRLSYRGAMVRKPSSTMWMETFSRYLLSANRSAIFLGPQGSLNLQAMYLDEYRDRLFLGGLDALYSLRLDQAWPDPREVLWPPQPGQREECVRKGRDPLTECANFVRVLQPHNRTHLLACGTGAFQPTCALITVGHRGEHVLHLEPGSVESGRG

SEQ ID NO: 11893 - protein, 99 aa, Homo Sapiens
  misc_feature (1)..(1): Xaa can be any naturally occurring amino acid
XSSGPSPGPSVPRLRLSYRDRVRQLRAGATASQPDPPASLWHWGLPAHLCPHHSWPPWGACAPPGAWQCGKWPGAVPSRAQPSLCQHLHRRGAVHGSHC

SEQ ID NO: 11894 - protein, 100 aa, Homo Sapiens
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNM

SEQ ID NO: 11895 - protein, 236 aa, Homo Sapiens
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNEELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVC

SEQ ID NO: 11896 - protein, 761 aa, Homo Sapiens
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 11897 - protein, 761 aa, Homo Sapiens; identical to SEQ ID NO: 11896

SEQ ID NO: 11898 - protein, 761 aa, Homo Sapiens; identical to SEQ ID NO: 11896

SEQ ID NO: 11899 - protein, 321 aa, Homo Sapiens
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIY

SEQ ID NO: 11900 - protein, 629 aa, Homo Sapiens
MIPWPASDRKKSECAFKKKSNEELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 11901 - protein, 220 aa, Homo Sapiens
MIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPH

SEQ ID NO: 11902 - protein, 723 aa, Homo Sapiens
MPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 11903 - protein, 51 aa, Homo Sapiens
MAGPCTWVLERPSLHSVATSASCQAGSTRSCFGVQTQRRNSSAASRARTHR

SEQ ID NO: 11904 - protein, 115 aa, Homo Sapiens
MAGPCTWVLERPSLHSVATSASCQAGSTRSCFGVQTQRRNSSAASRARTHSATVKTTSRSSCRSAAVTCSPVAQQPSAPCVPTSTWRTSPWQGTRRGMSSWKMARAVVPSTRISS

SEQ ID NO: 11905 - protein, 91 aa, Homo Sapiens
MLRTAMGLRSWLAAPWGALPPRPPLLLLLLLLLLLQPPPPTWALSPRISLPLGSEERPFLRFEAEHISNYTALLLSRDGRTLYVGAREALF

SEQ ID NO: 11906 - protein, 114 aa, Homo Sapiens
MLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADA

SEQ ID NO: 11907 - protein, 121 aa, Homo Sapiens
MLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCS

SEQ ID NO: 11908 - protein, 837 aa, Homo Sapiens
MLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCSFKGKDPQRDCQNYIKILLPLSGSHLFTCGTAAFSPMCTYINMENFTLARDEKGNVLLEDGKGRCPFDPNFKSTALVVDGELYTGTVSSFQGNDPAISRSQSLRPTKTESSLNWLQDPAFVASAYIPESLGSLQGDDDKIYFFFSETGQEFEFFENTIVSRIARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGDGRLHKAVSVGPRVHIIEELQIFSSGQPVQNLLLDTHRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSYWKEFLVMCTLFVLAVLLPVLFLLYRHRNSMKVFLKQGECASVHPKTCPVVLPPETRPLNGLGPPSTPLDHRGYQSLSDSPPGSRVFTESEKRPLSIQDSFVEVSPVCPRPRVRLGSEIRDSVV

SEQ ID NO: 11909 - protein, 837 aa, Homo Sapiens; identical to SEQ ID NO: 11908

SEQ ID NO: 11910 - protein, 63 aa, Homo Sapiens
MLRTAMGLRSWLAAPWGALPPRPPLLLLLLLLLLLQPPPPTWALSPRISLPLGWGYVKTLHRL

SEQ ID NO: 11911 - protein, 461 aa, Homo Sapiens
  misc_feature (1)..(1): Xaa can be any naturally occurring amino acid
XARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGDGRLHKAVSVGPRVHIIEELQIFSSGQPVQNLLLDTHRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSWARTQLLDLSSLYQAVATREDSASSGEIS

SEQ ID NO: 11912 - protein, 120 aa, Homo Sapiens
  misc_feature (1)..(1): Xaa can be any naturally occurring amino acid
XHIIEELQIFSSGQPVQNLLLDTHRGLLYAASHSGVVQVPMANCSLYRSCGDCLLARDPYCAWSGSSCKHVSLYQPQLATRILSGPQAVDPGHRGSQRQGPLQRVFGCVPVFCTNRGEAM

SEQ ID NO: 11913 - protein, 253 aa, Homo Sapiens
  misc_feature (1)..(1): Xaa can be any naturally occurring amino acid
XRSRMLLLQPQARYQRVAVHRVPGLHHTYDVLFLGTGDGRLHKAVSVGPRVHIIEELQIFSSGQPVQNLLLDTHRVSRPTRNPGRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVV

SEQ ID NO: 11914 - protein, 140 aa, Homo Sapiens
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYV

SEQ ID NO: 11915 - protein, 201 aa, Homo Sapiens
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSM

SEQ ID NO: 11916 - protein, 833 aa, Homo Sapiens
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSMKTEYLAFWLNEPHFVGSAYVPESVGSFTGDDDKVYFFFRERAVESDCYAEQVVARVARVCKGDMGGARTLQRKWTTFLKARLACSAPNWQLYFNQLQAMHTLQDTSWHNTTFFGVFQAQWGDMYLSAICEYQLEEIQRVFEGPYKEYHEEAQKWDRYTDPVPSPRPGSCINNWHRRHGYTSSLELPDNILNFVKKHPLMEEQVGPRWSRPLLVKKGTNFTHLVADRVTGLDGATYTVLFIGTGDGWLLKAVSLGPWVHLIEELQLFDQEPMRSLVLSQSKKLLFAGSRSQLVQLPVADCMKYRSCADCVLARDPYCAWSVNTSRCVAVGGHSGSLLIQHVMTSDTSGICNLRGSKKVRPTPKNITVVAGTDLVLPCHLSSNLAHARWTFGGRDLPAEQPGSFLYDARLQALVVMAAQPRHAGAYHCFSEEQGARLAAEGYLVAVVAGPSVTLEARAPLENLGLVWLAVVALGAVCLVLLLLVLSLRRRLREELEKGAKATERTLVYPLELPKEPTSPPFRPCPEPDEKLWDPVGYYYSDGSLKIVPGHARCQPGGGPPSPPPGIPGQPLPSPTRLHLGGGRNSNANGYVRLQLGGEDRGGLGHPLPELADELRRKLQQRQPLPDSNPEESSV

SEQ ID NO: 11917 - protein, 59 aa, Homo Sapiens
MRMCTPIRGLLMALAVMFGTAMAFAPIPRITWEHREVHLVQFHEPDIYNYSALLLSEDK

SEQ ID NO: 11918 - protein, 66 aa, Homo Sapiens
MRMCTPIRGLLMALAVMFGTAMAFAPIPRITWEHREVHLVQFHEPDIYNYSALLLSEDKDTLYIGA

SEQ ID NO: 11919 - protein, 76 aa, Homo Sapiens
MRMCTPIRGLLMALAVMFGTAMAFAPIPRITWEHREVHLVQFHEPDIYNYSALLLSEDKDTLYIGAREAVFAVNAL

SEQ ID NO: 11920 - protein, 146 aa, Homo Sapiens
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFL

SEQ ID NO: 11921 - protein, 862 aa, Homo Sapiens
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFLGKNEDGKGRCPFDPAHSYTSVMVDGELYSGTSYNFLGSEPIISRNSSHSPLRTEYAIPWLNEPSFVFADVIRKSPDSPDGEDDRVYFFFTEVSVEYEFVFRVLIPRIARVCKGDQGGLRTLQKKWTSFLKARLICSRPDSGLVFNVLRDVFVLRSPGLKVPVFYALFTPQLNNVGLSAVCAYNLSTAEEVFSHGKYMQSTTVEQSHTKWVRYNGPVPKPRPGACIDSEARAANYTSSLNLPDKTLQFVKDHPLMDDSVTPIDNRPRLIKKDVNYTQIVVDRTQALDGTVYDVMFVSTDRGALHKAISLEHAVHIIEETQLFQDFEPVQTLLLSSKKGNRFVYAGSNSGVVQAPLAFCGKHGTCEDCVLARDPYCAWSPPTATCVALHQTESPSRGLIQEMSGDASVCPDKSKGSYRQHFFKHGGTAELKCSQKSNLARVFWKFQNGVLKAESPKYGLMGRKNLLIFNLSEGDSGVYQCLSEERVKNKTVFQVVAKHVLEVKVVPKPVVAPTLSVVQTEGSRIATKVLVASTQGSSPPTPAVQATSSGAITLPPKPAPTGTSCEPKIVINTVPQLHSEKTMYLKSSDNRLLMSLFLFFFVLFLCLFFYNCYKGYLPRQCLKFRSALLIGKKKPKSDFCDREQSLKETLVEPGSFSQQNGEHPKPALDTGYETEQDTITSKVPTDREDSQRIDDLSARDKPFDVKCELKFADSDADGD

SEQ ID NO: 11922 - protein, 738 aa, Homo Sapiens
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFLGKNEDGKGRCPFDPAHSYTSVMVDGELYSGTSYNFLGSEPIISRNSSHSPLRTEYAIPWLNEPSFVFADVIRKSPDSPDGEDDRVYFFFTEVSVEYEFVFRVLIPRIARVCKGDQGGLRTLQKKWTSFLKARLICSRPDSGLVFNVLRDVFVLRSPGLKVPVFYALFTPQLNNVGLSAVCAYNLSTAEEVFSHGKYMQSTTVEQSHTKWVRYNGPVPKPRPGACIDSEARAANYTSSLNLPDKTLQFVKDHPLMDDSVTPIDNRPRLIKKDVNYTQIVVDRTQALDGTVYDVMFVSTDRGALHKAISLEHAVHIIEETQLFQDFEPVQTLLLSSKKGNRFVYAGSNSGVVQAPLAFCGKHGTCEDCVLARDPYCAWSPPTATCVALHQTESPSRGLIQEMSGDASVCPASSPKPLPPPGSSSLSCLGHVGDRRLSSPWTPWPASGAGPDSSSRVSLLPPFLSDQAQHVHALGNFYLFCQATGPADIRFVWEKNGRALETCVPVQTHALPDGRAHALSWLQDAIRESAEYRCSVLSSAGNKTSKVQVAVMRPEVTHQERWTRELSAWRAVAGEHDRMMQSWRKAWESCSKDTL

SEQ ID NO: 11923 - protein, 738 aa, Homo Sapiens; identical to SEQ ID NO: 11922

SEQ ID NO: 11924 - protein, 862 aa, Homo Sapiens; identical to SEQ ID NO: 11921

SEQ ID NO: 11925 - protein, 862 aa, Homo Sapiens; identical to SEQ ID NO: 11921

SEQ ID NO: 11926 - protein, 548 aa, Homo Sapiens
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFLGKNEDGKGRCPFDPAHSYTSVMVDGELYSGTSYNFLGSEPIISRNSSHSPLRTEYAIPWLNEPSFVFADVIRKSPDSPDGEDDRVYFFFTEVSVEYEFVFRVLIPRIARVCKGDQGGLRTLQKKWTSFLKARLICSRPDSGLVFNVLRDVFVLRSPGLKVPVFYALFTPQLNNVGLSAVCAYNLSTAEEVFSHGKYMQSTTVEQSHTKWVRYNGPVPKPRPGACIDSEARAANYTSSLNLPDKTLQFVKDHPLMDDSVTPIDNRPRLIKKDVNYTQIVVDRTQALDGTVYDVMFVSTDRGALHKAISLEHAVHIIEETQLFQDFEPVQTLLLSSKKVLQTFALSGRRMGELWRPVSLCRPMHCPMAGPMHSAGCRTPSGKALSIAALSSPQQGTRLRRCRLL

SEQ ID NO: 11927 - protein, 738 aa, Homo Sapiens; identical to SEQ ID NO: 11922

SEQ ID NO: 11928 - protein, 862 aa, Homo Sapiens; identical to SEQ ID NO: 11921

SEQ ID NO: 11929 - protein, 548 aa, Homo Sapiens; identical to SEQ ID NO: 11926

SEQ ID NO: 11930 - protein, 123 aa, Homo Sapiens
MWTQRWKRSVSPGPADIRFVWEKNGRALETCVPVQTHALPDGRAHALSWLQDAIRESAEYRCSVLSSAGNKTSKVQVAVMRPEVTHQERWTRELSAWRAVAGEHDRMMQSWRKAWESCSKDTL

SEQ ID NO: 11931 - protein, 49 aa, Homo Sapiens
MPASAARPRPGPGQPTASPFPLLLLAVLSGPVSGRVPRSVPRTSLPISD

SEQ ID NO: 11932 - protein, 770 aa, Homo Sapiens
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDECHNFVQILAIANASHLLTCGTFAFDPKCGVIDVSRFQQVERLESGRGKCPFEPAQRSAAVMAGGVLYAATVKNYLGTEPIITRAVGRAEDWIRTDTLPSWLNAPAFVAAVALSPAEWGDEDGDDEIYFFFTETSRAFDSYERIKVPRVARVCAGDLGGRKTLQQRWTTFLKADLLCPGPEHGRASSVLQDVAVLRPELGAGTPIFYGIFSSQWEGATISAVCAFRPQDIRTVLNGPFRELKHDCNRGLPVVDNDVPQPRPGECITNNMKLRHFGSSLSLPDRVLTFIRDHPLMDRPVFPADGHPLLVTTDTAYLRVVAHRVTSLSGKEYDVLYLGTEDGHLHRAVRIGAQLSVLEDLALFPEPQPVENMKLYHSWLLVGSRTEVTQVNTTNCGRLQSCSECILAQDPVCAWSFRLDECVAHAGEHRGLVQDIESADVSSLCPKEPGERPVVFEVPVATAAHVVLPCSPSSAWASCVWHQPSGVTALTPRRDGLEVVVTPGAMGAYACECQEGGAAHVVAAYSLVWGSQRDAPSRAHTVGAGLAGFFLGILAASLTLILIGRRQQRRRQRELLARDKVGLDLGAPPSGTTSYSQDPPSPSPEDERLPLALAKRGSGFGGFSPPFLLDPCPSPAHIRLTGAPLATCDETSI

SEQ ID NO: 11933 - protein, 160 aa, Homo Sapiens
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDECHNFVQILAIANASHLLTCGTFAFDPKCGVIGGSSMLPL

SEQ ID NO: 11934 - protein, 165 aa, Homo Sapiens
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDVSRFQQVERLESGRGKCPFEPAQRSAAVMAGGVLYAATVKNYLGT

SEQ ID NO: 11935 - protein, 737 aa, Homo Sapiens
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDVSRFQQVERLESGRGKCPFEPAQRSAAVMAGGVLYAATVKNYLGTEPIITRAVGRAEDWIRTDTLPSWLNAPAFVAAVALSPAEWGDEDGDDEIYFFFTETSRAFDSYERIKVPRVARVCAGDLGGRKTLQQRWTTFLKADLLCPGPEHGRASSVLQDVAVLRPELGAGTPIFYGIFSSQWEGATISAVCAFRPQDIRTVLNGPFRELKHDCNRGLPVVDNDVPQPRPGECITNNMKLRHFGSSLSLPDRVLTFIRDHPLMDRPVFPADGHPLLVTTDTAYLRVVAHRVTSLSGKEYDVLYLGTEDGHLHRAVRIGAQLSVLEDLALFPEPQPVENMKLYHSWLLVGSRTEVTQVNTTNCGRLQSCSECILAQDPVCAWSFRLDECVAHAGEHRGLVQDIESADVSSLCPKEPGERPVVFEVPVATAAHVVLPCSPSSAWASCVWHQPSGVTALTPRRDGLEVVVTPGAMGAYACECQEGGAAHVVAAYSLVWGSQRDAPSRAHTVGAGLAGFFLGILAASLTLILIGRRQQRRRQRELLARDKVGLDLGAPPSGTTSYSQDPPSPSPEDERLPLALAKRGSGFGGFSPPFLLDPCPSPAHIRLTGAPLATCDETSI

SEQ ID NO: 11936 - protein, 178 aa, Homo Sapiens
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEGDLGGRKTLQQRWTTFLKADLLCPGPEHGRASSVLQDVAVLRPELGAGTPIFYGIFSSQ

SEQ ID NO: 11937 - protein, 615 aa, Homo Sapiens
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEGDLGGRKTLQQRWTTFLKADLLCPGPEHGRASSVLQDVAVLRPELGAGTPIFYGIFSSQWEGATISAVCAFRPQDIRTVLNGPFRELKHDCNRGLPVVDNDVPQPRPGECITNNMKLRHFGSSLSLPDRVLTFIRDHPLMDRPVFPADGHPLLVTTDTAYLRVVAHRVTSLSGKEYDVLYLGTEDGHLHRAVRIGAQLSVLEDLALFPEPQPVENMKLYHSWLLVGSRTEVTQVNTTNCGRLQSCSECILAQDPVCAWSFRLDECVAHAGEHRGLVQDIESADVSSLCPKEPGERPVVFEVPVATAAHVVLPCSPSSAWASCVWHQPSGVTALTPRRDGLEVVVTPGAMGAYACECQEGGAAHVVAAYSLVWGSQRDAPSRAHTVGAGLAGFFLGILAASLTLILIGRRQQRRRQRELLARDKVGLDLGAPPSGTTSYSQDPPSPSPEDERLPLALAKRGSGFGGFSPPFLLDPCPSPAHIRLTGAPLATCDETSI

SEQ ID NO: 11938 - protein, 127 aa, Homo Sapiens
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEGGSSMLPL

SEQ ID NO: 11939 - protein, 68 aa, Homo Sapiens
MPASAARPRPGPGQPTASPFPLLLLAVLSGPVSGRVPRSVPRTSLPISVFRRKNRGGGYDPLKRCGRS

SEQ ID NO: 11940 - protein, 127 aa, Homo Sapiens
MGSMSPPSAWPCVLDGPETRQDLCQPPKPCVHSHAHMEECLSAGLQCPHPHLLLVHSCFIPASGLGVPSQLPHPIWSSSPAPCGDLFVKSLGTGQPGEVRLHHSPPLPSCVALVNQPPHSPWSFSRV

SEQ ID NO: 11941 - protein, 170 aa, Homo Sapiens
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARG

SEQ ID NO: 11942 - protein, 843 aa, Homo Sapiens
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARDPYCGWDPGTHACAAATTIANRSQGSRTALIQDIERGNRGCESSRDTGPPPPLKTRSVLRGDDVLLPCDQPSNLARALWLLNGSMGLSDGQGGYRVGVDGLLVTDAQPEHSGNYGCYAEENGLRTLLASYSLTVRPATPAPAPKAPATPGAQLAPDVRLLYVLAIAALGGLCLILASSLLYVACLREGRRGRRRKYSLGRASRAGGSAVQLQTVSGQCPGEEDEGDDEGAGGLEGSCLQIIPGEGAPAPPPPPPPPPPAELTNGLVALPSRLRRMNGNSYVLLRQSNNGVPAGPCSFAEELSRILEKRKHTQLVEQLDESSV

SEQ ID NO: 11943 - protein, 838 aa, Homo Sapiens
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARDPYCGWDPGTHACAAATTIANRTALIQDIERGNRGCESSRDTGPPPPLKTRSVLRGDDVLLPCDQPSNLARALWLLNGSMGLSDGQGGYRVGVDGLLVTDAQPEHSGNYGCYAEENGLRTLLASYSLTVRPATPAPAPKAPATPGAQLAPDVRLLYVLAIAALGGLCLILASSLLYVACLREGRRGRRRKYSLGRASRAGGSAVQLQTVSGQCPGEEDEGDDEGAGGLEGSCLQIIPGEGAPAPPPPPPPPPPAELTNGLVALPSRLRRMNGNSYVLLRQSNNGVPAGPCSFAEELSRILEKRKHTQLVEQLDESSV

SEQ ID NO: 11944 - protein, 702 aa, Homo Sapiens
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARDPYCGWDPGTHACAAATTIANRSQGSRTALIQDIERGNRGCESSRDTGRALQVHMGSMSPPSAWPCVLDGPETRQDLCQPPKPCVHSHAHMEECLSAGLQCPHPHLLLVHSCFIPASGLGVPSQLPHPIWSSSPAPCGDLFVKSLGTGQPGEVRLHHSPPLPSCVALVNQPPHSPWSFSRV

SEQ ID NO: 11945 - protein, 522 aa, Homo Sapiens
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARD

SEQ ID NO: 11946 - protein, 838 aa, Homo Sapiens; identical to SEQ ID NO: 11943

SEQ ID NO: 11947 - protein, 132 aa, Homo Sapiens
  misc_feature (1)..(1): Xaa can be any naturally occurring amino acid
XREGRRGRRRKYSLGRASRAGGSAVQLQTVSGRALQVHMGSMSPPSAWPCVLDGPETRQDLCQPPKPCVHSHAHMEECLSAGLQCPHPHLLLVHSCFIPASGLGVPSQLPHPIWSSSPAPCGDLFVKSLGTG

SEQ ID NO: 11948 - protein, 254 aa, Homo Sapiens
MKGTCVIAWLFSSLGLWRLAHPEAQGTTQCQRTEHPVISYKEIGPWLREFRAKNAVDFSQLTFDPGQKELVVGARNYLFRLQLEDLSLIQAVEWECDEATKKACYSKGKSKEECQNYIRVLLVGGDRLFTCGTNAFTPVCTNRSLSNLTEIHDQISGMARCPYSPQHNSTALLTAGGELYAATAMDFPGRDPAIYRSLGILPPLRTAQYNSKWLNEPNFVSSYDIGNFTYFFFRENAVEHDCGKTVFSRAARVC

SEQ ID NO: 11949 - protein, 1074 aa, Homo Sapiens
MKGTCVIAWLFSSLGLWRLAHPEAQGTTQCQRTEHPVISYKEIGPWLREFRAKNAVDFSQLTFDPGQKELVVGARNYLFRLQLEDLSLIQAVEWECDEATKKACYSKGKSKEECQNYIRVLLVGGDRLFTCGTNAFTPVCTNRSLSNLTEIHDQISGMARCPYSPQHNSTALLTAGGELYAATAMDFPGRDPAIYRSLGILPPLRTAQYNSKWLNEPNFVSSYDIGNFTYFFFRENAVEHDCGKTVFSRAARVCKNDIGGRFLLEDTWTTFMKARLNCSRPGEVPFYYNELQSTFFLPELDLIYGIFTTNVNSIAASAVCVFNLSAIAQAFSGPFKYQENSRSAWLPYPNPNPHFQCGTVDQGLYVNLTERNLQDAQKFILMHEVVQPVTTVPSFMEDNSRFSHVAVDVVQGREALVHIIYLATDYGTIKKVRVPLNQTSSSCLLEEIELFPERRREPIRSLQILHSQSVLFVGLREHVVKIPLKRCQFYRTRSTCIGAQDPYCGWDVVMKKCTSLEESLSMTQWEQSISACPTRNLTVDGHFGVWSPWTPCTHTDGSAVGSCLCRTRSCDSPAPQCGGWQCEGPGMEIANCSRNGGWTPWTSWSPCSTTCGIGFQVRQRSCSNPTPRHGGRVCVGQNREERYCNEHLLCPPHMFWTGWGPWERCTAQCGGGIQARRRICENGPDCAGCNVEYQSCNTNPCPELKKTTPWTPWTPVNISDNGGHYEQRFRYTCKARLADPNLLEVGRQRIEMRYCSSDGTSGCSTDGLSGDFLRAGRYSAHTVNGAWSAWTSWSQCSRDCSRGIRNRKRVCNNPEPKYGGMPCLGPSLEYQECNILPCPVDGVWSCWSPWTKCSATCGGGHYMRTRSCSNPAPAYGGDICLGLHTEEALCNTQPCPESWSEWSDWSECEASGVQVRARQCILLFPMGSQCSGNTTESRPCVFDSNFIPEVSVARSSSVEEKRCGEFNMFHMIAVGLSSSILGCLLTLLVYTYCQRYQQQSHDATVIHPVSPAPLNTSITNHINKLDKYDSVEAIKAFNKNNLILEERNKYFNPHLTGKTYSNAYFTDLNNYDEY

SEQ ID NO: 11950 - protein, 409 aa, Homo Sapiens
MKNASPETREGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 11951 - protein, 457 aa, Homo Sapiens
MKTGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 11952 - protein, 114 aa, Homo Sapiens
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHK

SEQ ID NO: 11953 - protein, 159 aa, Homo Sapiens
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEF

SEQ ID NO: 11954 - protein, 1047 aa, Homo Sapiens
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNDISTPLPDNEMSYNTVYGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 11955 - protein, 1030 aa, Homo Sapiens
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 11956 - protein, 1030 aa, Homo Sapiens; identical to SEQ ID NO: 11955

SEQ ID NO: 11957 - protein, 545 aa, Homo Sapiens
  misc_feature (1)..(1): Xaa can be any naturally occurring amino acid
XYQNHTVVFLGSEKGIILKFLARIGNSGFLNDSLFLEEMSVYNSEKCSYDGVEDKRIMGMQLDRASSSLYVAFSTCVIKVPLGRCERHGKCKKTCIASRDPYCGWIKEGGACSHLSPNSRLTFEQDIERGNTDGLGDCHNSFVALNGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 11958 - protein, 930 aa, Homo Sapiens
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQDGATGSQSGPGDSAYGVRRDLPPASASRSVPIPLLLASVAAAFALGASVSGLLVSCACRRAHRRRGKDIETPGLPRPLSLRSLARLHGGGPEPPPPSKDGDAVQTPQLYTTFLPPPEGVPPPELACLPTPESTPELPVKHLRAAGDPWEWNQNRNNAKEGPGRSRGGHAAGGPAPRVLVRPPPPGCPGQAVEVTTLEELLRYLHGPQPPRKGAEPPAPLTSRALPPEPAPALLGGPSPRPHECASPLRLDVPPEGRCASAPARPALSAPAPRLGVGGGRRLPFSGHRAPPALLTRVPSGGPSRYSGGPGKHLLYLGRPEGYRGRALKRVDVEKPQLSLKPPLVGPSSRQAVPNGGRFNF

SEQ ID NO: 11959 - protein, 930 aa, Homo Sapiens; identical to SEQ ID NO: 11958

SEQ ID NO: 11960 - protein, 962 aa, Homo Sapiens
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQDGATGSQSGPGDSAYVLPGPGPSPGTPSPPSDAHPRPQSSTLGVHTRGVRRDLPPASASRSVPIPLLLASVAAAFALGASVSGLLVSCACRRAHRRRGKDIETPGLPRPLSLRSLARLHGGGPEPPPPSKDGDAVQTPQLYTTFLPPPEGVPPPELACLPTPESTPELPVKHLRAAGDPWEWNQNRNNAKEGPGRSRGGHAAGGPAPRVLVRPPPPGCPGQAVEVTTLEELLRYLHGPQPPRKGAEPPAPLTSRALPPEPAPALLGGPSPRPHECASPLRLDVPPEGRCASAPARPALSAPAPRLGVGGGRRLPFSGHRAPPALLTRVPSGGPSRYSGGPGKHLLYLGRPEGYRGRALKRVDVEKPQLSLKPPLVGPSSRQAVPNGGRFNF

SEQ ID NO: 11961 - protein, 537 aa, Homo Sapiens [sequence omitted]

SEQ ID NO: 11962 - protein, 537 aa, Homo Sapiens
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCPAHSSPLGRSLQVLRGSREAPPVPGPARGLPGPRPEKGGRREAPVVPEASPRRALLPPGRPERRPFQLLKGAAHGLQRGERPSPLGHELDALQDVSPPPRPAPPAFPTRRVSRGPFSPRVYLLTVFPPVLDRRVGGEKPVSSVSQHFRGSWRTPTPRSLPAKLP

SEQ ID NO: 11963 - protein, 922 aa, Homo Sapiens
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQDGATGSQSGPGDSAYVLPGPGPSPGTPSPPSDAHPRPQSSTLGVHTRGVRRDLPPASASRSVPIPLLLASVAAAFALGASVSGLLVSCACRRAHRRRGKDIETPGLPRPLSLRSLARLHGGGPEPPPPSKDGDAVQTPQLYTTFLPPPEGVPPPELACLPTPESTPELPVKHLRAAGDPWEWNQNRNNAKEGPGRSRGGHAAGGPAPRVLVRPPPPGCPGQAVEVTTLEELLRYLHGPQPPRKGAEPPAPLTSRALPPEPAPALLGGPSPRPHECASPLRLDVPPEGRCASAPARPALSAPAPRLGVGGGRRLPFSGHRAPPALLTRVPSGGPSRYSGGPGKHLLYLGRPEGYRGRALKRVDVEKPQLSLKPPLVGPSSRQAVPNGGRFNF

SEQ ID NO: 11964 - protein, 22 aa, Homo Sapiens
MRVFLLCAYILLLMVSQLRAVS

SEQ ID NO: 11965 - protein, 148 aa, Homo Sapiens
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYY

SEQ ID NO: 11966 - protein, 219 aa, Homo Sapiens
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIK

SEQ ID NO: 11967 - protein, 1073 aa, Homo Sapiens
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHEILPTSTTPDYKIFGGPTSDMEVSSSSVTTMASIPEITPKVIDTWRPKLTSSRKFVVQDDPNTSDFTDPLSGIPKGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 11968 - protein, 597 aa, Homo Sapiens
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHDMEVSSSSVTTMVYDGKSSLESPTRWST

SEQ ID NO: 11969 - protein, 1011 aa, Homo Sapiens
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLLLTEDFFAFHNHSAEGYEQDTEFGNTAHLGDCHGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 11970 - protein, 1017 aa, Homo Sapiens
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHEILPTSTTPDYKIFGGPTSGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 11971 - protein, 476 aa, Homo Sapiens
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAK

SEQ ID NO: 11972 - protein, 998 aa, Homo Sapiens
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 11973 - protein, 1073 aa, Homo Sapiens; identical to SEQ ID NO: 11967

SEQ ID NO: 11974 - protein, 597 aa, Homo Sapiens; identical to SEQ ID NO: 11968

SEQ ID NO: 11975 - protein, 1011 aa, Homo Sapiens; identical to SEQ ID NO: 11969

SEQ ID NO: 11976 - protein, 54 aa, Homo Sapiens
  misc_feature (1)..(1): Xaa can be any naturally occurring amino acid
XLLTEDFFAFHNHSAEGYEQDTEFGNTAHLGDCHEILPTSTTPDYKIFGGPTSG

SEQ ID NO: 11977 - protein, 198 aa, Homo Sapiens
  misc_feature (1)..(1): Xaa can be any naturally occurring amino acid
XLTEDFFAFHNHSAEGYEQDTEFGNTAHLGDCHEILPTSTTPDYKIFGGPTSDMEVSSSSVTTMASIPEITPKVIDTWRPKLTSSRKFVVQDDPNTSDFTDPLSGIPKGVRWEVQSGESNQMVHMNVLITCVFAAFVLGAFIAGVAVYCYRDMFVRKNRKIHKDAESAQSCTDSSGSFAKLNGLFDSPVKEYQQNIDS

SEQ ID NO: 11978 - protein, 462 aa, Homo Sapiens
MKPNIIFVLSLLLILEKQAAVMGQKGGSKGRLPSEFSQFPHGQKGQHYSGQKGKQQTESKGSFSIQYTYHVDANDHDQSRKSQQYDLNALHKTTKSQRHLGGSQQLLHNKQEGRDHDKSKGHFHRVVIHHKGGKAHRGTQNPSQDQGNSPSGKGISSQYSNTEERLWVHGLSKEQTSVSGAQKGRKQGGSQSSYVLQTEELVANKQQRETKNSHQNKGHYQNVVEVREEHSSKVQTSLCPAHQDKLQHGSKDIFSTQDELLVYNKNQHQTKNLNQDQQHGRKANKISYQSSSTEERRLHYGENGVQKDVSQSSIYSQTEEKAQGKSQKQITIPSQEQEHSQKANKISYQSSSTEERRLHYGENGVQKDVSQRSIYSQTEKLVAGKSQIQAPNPKQEPWHGENAKGESGQSTNREQDLLSHEQKGRHQHGSHGGLDIVIIEQEDDSDRHLAQHLNNDRNPLFT

SEQ ID NO: 11979 - protein, 582 aa, Homo Sapiens
MKSIILFVLSLLLILEKQAAVMGQKGGSKGQLPSGSSQFPHGQKGQHYFGQKDQQHTKSKGSFSIQHTYHVDINDHDWTRKSQQYDLNALHKATKSKQHLGGSQQLLNYKQEGRDHDKSKGHFHMIVIHHKGGQAHHGTQNPSQDQGNSPSGKGLSSQCSNTEKRLWVHGLSKEQASASGAQKGRTQGGSQSSYVLQTEELVVNKQQRETKNSHQNKGHYQNVVDVREEHSSKLQTSLHPAHQDRLQHGPKDIFTTQDELLVYNKNQHQTKNLSQDQEHGRKAHKISYPSSRTEERQLHHGEKSVQKDVSKGSISIQTEEKIHGKSQNQVTIHSQDQEHGHKENKISYQSSSTEERHLNCGEKGIQKGVSKGSISIQTEEQIHGKSQNQVRIPSQAQEYGHKENKISYQSSSTEERRLNSGEKDVQKGVSKGSISIQTEEKIHGKSQNQVTIPSQDQEHGHKENKMSYQSSSTEERRLNYGGKSTQKDVSQSSISFQIEKLVEGKSQIQTPNPNQDQWSGQNAKGKSGQSADSKQDLLSHEQKGRYKQESSESHNIVITEHEVAQDDHLTQQYNEDRNPIST

SEQ ID NO: 11980 - protein, 57 aa, Homo Sapiens
MADTPRDAGLKQAPASRNEKAPVDFGYVGIDSILEQMRRKAMKQGFEFNIMVVERLG

SEQ ID NO: 11981 - protein, 104 aa, Homo Sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVR

SEQ ID NO: 11982 - protein, 108 aa, Homo Sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLT

SEQ ID NO: 11983 - protein, 116 aa, Homo Sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFG

SEQ ID NO: 11984 - protein, 127 aa, Homo Sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQP

SEQ ID NO: 11985 - protein, 135 aa, Homo Sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQ

SEQ ID NO: 11986 - protein, 144 aa, Homo Sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEV

SEQ ID NO: 11987 - protein, 151 aa, Homo Sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKR

SEQ ID NO: 11988 - protein, 157 aa, Homo Sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRV

SEQ ID NO: 11989 - protein, 165 aa, Homo Sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIP

SEQ ID NO: 11990 - protein, 195 aa, Homo Sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKA

SEQ ID NO: 11991 - protein, 209 aa, Homo Sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQR

SEQ ID NO: 11992 - protein, 209 aa, Homo Sapiens; identical to SEQ ID NO: 11991

SEQ ID NO: 11993 - protein, 335 aa, Homo Sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 11994 - protein, 335 aa, Homo Sapiens; identical to SEQ ID NO: 11993

SEQ ID NO: 11995 - protein, 335 aa, Homo Sapiens; identical to SEQ ID NO: 11993

SEQ ID NO: 11996 - protein, 362 aa, Homo Sapiens
MAGAGCTGTWSWLWGTATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 11997 - protein, 35 aa, Homo Sapiens
MEPPASKVPEVPTAPATDAAPKRVEIQMPKPAEAP

SEQ ID NO: 11998 - protein, 422 aa, Homo Sapiens
MEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 11999 - protein, 422 aa, Homo Sapiens; identical to SEQ ID NO: 11998

SEQ ID NO: 12000 - protein, 422 aa, Homo Sapiens; identical to SEQ ID NO: 11998

SEQ ID NO: 12001 - protein, 422 aa, Homo Sapiens; identical to SEQ ID NO: 11998

SEQ ID NO: 12002 - protein, 568 aa, Homo Sapiens
MERDRISALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 12003 - protein, 568 aa, Homo Sapiens; identical to SEQ ID NO: 12002

SEQ ID NO: 12004 - protein, 159 aa, Homo Sapiens
MGSFRTSKMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEI

SEQ ID NO: 12005 - protein, 474 aa, Homo Sapiens
MGSSFWEGLQVAVGLPQGCWPQGLDSGEPAEGGQLEAAPVCIVTRQSKETAGPTLGRGGWRQGSLRRGKGTSCRCRQLSPGHGPGRLTGCGECHRLPCRGLVSGFTGLRGQEEDDLAFCLATIGSDRQATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 12006 - protein, 23 aa, Homo Sapiens
MHLAAEHCVCDSPPSSWNHPPQV

SEQ ID NO: 12007 - protein, 125 aa, Homo Sapiens
MIICPTRPFTALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGH

SEQ ID NO: 12008 - protein, 90 aa, Homo Sapiens
MKDFGSRQEFDSVENAGAIGPSRFGLKRAEVLGHKTPEPAPRRTEITIVKPQESAHRRMEPPASKPEVGAAHLRGAHPQDHRDQVHHARY

SEQ ID NO: 12009 - protein, 134 aa, Homo Sapiens
MKDFGSRQEFDSVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQE

SEQ ID NO: 12010 - protein, 567 aa, Homo Sapiens
MKKSYSALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 12011 - protein, 44 aa, Homo Sapiens
MKKSYSDLLLDPCISNLASLHCARFSGARHRRICSCLVIFDSAR

SEQ ID NO: 12012 - protein, 586 aa, Homo Sapiens
MKKSYSGGTRTSSGRLRRLGDSSGPALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 12013 - protein, 151 aa, Homo Sapiens
MLWPEEEPWGGRCACVTEACPADAGPLTSRRGSLKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPE

SEQ ID NO: 12014 - protein, 189 aa, Homo Sapiens
MPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGESSPCMPLNQCRKPASAPRAAHKPLGLVFPSVKWGSNPDLKDGLPVTLRVHACAWEEPTASSGSSEGPVLHIQGP

SEQ ID NO: 12015 - protein, 579 aa, Homo Sapiens
MSDPAVNAQLDGIISDFEALKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEPPASKVPEVPTAPATDAAPKRVEIQMPKPAEAPTAPSPAQTLENSEPAPVSQLQSRLEPKPQPPVAEATPRSQEATEAAPSCVGDMADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEYQVNGKRILGRKTKWGTIEVENTTHCEFAYLRDLLIRTHMQNIKDITSSIHFEAYRVKRLNEGSSAMANGMEEKEPEAPEM

SEQ ID NO: 12016 - protein, 152 aa, Homo Sapiens
MTSMSAGTINTLKRSFEVEEVETPNSTPPRRVQTPLLRATVASSTQKFQDLGVKNSEPSARHVDSLSQRSPKASLRRVELSGPKAAEPVSRRTELSIDISSKQVENAGAIGPSRFGLKRAEVLGHKTPEPAPRRTEITIVKPQESAHRRMEP

SEQ ID NO: 12017 - protein, 105 aa, Homo Sapiens
MLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQG

SEQ ID NO: 12018 - protein, 22 aa, Homo Sapiens
MPSSVSWGILLLAGLCCLVPVS

SEQ ID NO: 12019 - protein, 92 aa, Homo Sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGT

SEQ ID NO: 12020 - protein, 117 aa, Homo Sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIH

SEQ ID NO: 12021 - protein, 144 aa, Homo Sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFL

SEQ ID NO: 12022 - protein, 156 aa, Homo Sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLE

SEQ ID NO: 12023 - protein, 418 aa, Homo Sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 12024 - protein, 418 aa, Homo Sapiens; identical to SEQ ID NO: 12023

SEQ ID NO: 12025 - protein, 359 aa, Homo Sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKVRSP

SEQ ID NO: 12026 - protein, 418 aa, Homo Sapiens; identical to SEQ ID NO: 12023

SEQ ID NO: 12027 - protein, 418 aa, Homo Sapiens; identical to SEQ ID NO: 12023

SEQ ID NO: 12028 - protein, 418 aa, Homo Sapiens; identical to SEQ ID NO: 12023

SEQ ID NO: 12029 - protein, 418 aa, Homo Sapiens; identical to SEQ ID NO: 12023

SEQ ID NO: 12030 - protein, 418 aa, Homo Sapiens; identical to SEQ ID NO: 12023

SEQ ID NO: 12031 - protein, 418 aa, Homo Sapiens; identical to SEQ ID NO: 12023

SEQ ID NO: 12032 - protein, 306 aa, Homo Sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRR

SEQ ID NO: 12033 - protein, 418 aa, Homo Sapiens; identical to SEQ ID NO: 12023

SEQ ID NO: 12034 - protein, 444 aa, Homo Sapiens
MKVVPSLLLSVLLAQVWLVPGLAPSPQSPETPAPQNQTSRVVQAPKEEEEDEQEASEEKASEEEKAWLMASRQQLAKETSNFGFSLLRKISMRHDGNMVFSPFGMSLAMTGLMLGATGPTETQIKRGLHLQALKPTKPGLLPSLFKGLRETLSRNLELGLTQGSFAFIHKDFDVKETFFNLSKRYFDTECVPMNFRNASQAKRLMNHYINKETRGKIPKLFDEINPETKLILVDYILFKGKWLTPFDPVFTEVDTFHLDKYKTIKVPMMYGAGKFASTFDKNFRCHVLKLPYQGNATMLVVLMEKMGDHLALEDYLTTDLVETWLRNMKTRNMEVFFPKFKLDQKYEMHELLRQMGIRRIFSPFADLSELSATGRNLQVSRVLQRTVIEVDERGTEAVAGILSEITAYSMPPVIKVDRPFHFMIYEETSGMLLFLGRVVNPTLL

SEQ ID NO: 12035 - protein, 444 aa, Homo Sapiens; identical to SEQ ID NO: 12034

SEQ ID NO: 12036 - protein, 444 aa, Homo Sapiens; identical to SEQ ID NO: 12034

SEQ ID NO: 12037 - protein, 484 aa, Homo Sapiens
MSRSTQELLGYHCRLQDKLQEQEGSLAAEGRHSLASAADHMKVVPSLLLSVLLAQVWLVPGLAPSPQSPETPAPQNQTSRVVQAPKEEEEDEQEASEEKASEEEKAWLMASRQQLAKETSNFGFSLLRKISMRHDGNMVFSPFGMSLAMTGLMLGATGPTETQIKRGLHLQALKPTKPGLLPSLFKGLRETLSRNLELGLTQGSFAFIHKDFDVKETFFNLSKRYFDTECVPMNFRNASQAKRLMNHYINKETRGKIPKLFDEINPETKLILVDYILFKGKWLTPFDPVFTEVDTFHLDKYKTIKVPMMYGAGKFASTFDKNFRCHVLKLPYQGNATMLVVLMEKMGDHLALEDYLTTDLVETWLRNMKTRNMEVFFPKFKLDQKYEMHELLRQMGIRRIFSPFADLSELSATGRNLQVSRVLQRTVIEVDERGTEAVAGILSEITAYSMPPVIKVDRPFHFMIYEETSGMLLFLGRVVNPTLL

SEQ ID NO: 12038 - protein, 422 aa, Homo Sapiens
MGPAWLWLLGTGILASVHCQPLLAHGDKSLQGPQPPRHQLSEPAPAYHRITPTITNFALRLYKELAADAPGNIFFSPVSISTTLALLSLGAQANTSALILEGLGFNLTETPEADIHQGFRSLLHTLALPSPKLELKVGNSLFLDKRLKPRQHYLDSIKELYGAFAFSANFTDSVTTGRQINDYLRRQTYGQVVDCLPEFSQDTFMVLANYIFFKAKWKHPFSRYQTQKQESFFVDERTSLQVPMMHQKEMHRFLYDQDLACTVLQIEYRGNALALLVLPDPGKMKQVEAALQPQTLRKWGQLLLPSLLDLHLPRFSISGTYNLEDILPQIGLTNILNLEADFSGVTGQLNKTISKVSHKAMVDMSEKGTEAGAASGLLSQPPSLNTMSDPHAHFNRPFLLLLWEVTTQSLLFLGKVVNPVAG

SEQ ID NO: 12039 - protein, 414 aa, Homo Sapiens
MNPTLGLAIFLAVLLTVKGLLKPSFSPRNYKALSEVQGWKQRMAAKELARQNMDLGFKLLKKLAFYNPGRNIFLSPLSISTAFSMLCLGAQDSTLDEIKQGFNFRKMPEKDLHEGFHYIIHELTQKTQDLKLSIGNTLFIDQRLQPQRKFLEDAKNFYSAETILTNFQNLEMAQKQINDFISQKTHGKINNLIENIDPGTVMLLANYIFFRARWKHEFDPNVTKEEDFFLEKNSSVKVPMMFRSGIYQVGYDDKLSCTILEIPYQKNITAIFILPDEGKLKHLEKGLQVDTFSRWKTLLSRRVVDVSVPRLHMTGTFDLKKTLSYIGVSKIFEEHGDLTKIAPHRSLKVGEAVHKAELKMDERGTEGAAGTGAQTLPMETPLVVKIDKPYLLLIYSEKIPSVLFLGKIVNPIGK

SEQ ID NO: 12040 - protein, 414 aa, Homo Sapiens; identical to SEQ ID NO: 12039

SEQ ID NO: 12041 - protein, 423 aa, Homo Sapiens
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKQA

SEQ ID NO: 12042 - protein, 423 aa, Homo Sapiens; identical to SEQ ID NO: 12041

SEQ ID NO: 12043 - protein, 423 aa, Homo Sapiens; identical to SEQ ID NO: 12041

SEQ ID NO: 12044 - protein, 305 aa, Homo Sapiens
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEF

SEQ ID NO: 12045 - protein, 216 aa, Homo Sapiens
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKER

SEQ ID NO: 12046 - protein, 205 aa, Homo Sapiens
MPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKQA

SEQ ID NO: 12047 - protein, 46 aa, Homo Sapiens
  misc_feature (1)..(1): Xaa can be any naturally occurring amino acid
XTVVELKYTGNASALFILPDQDKMEEVEAMLLPETLKRWRDSLEFR

SEQ ID NO: 12048 - protein, 427 aa, Homo Sapiens
MHLIDYLLLLLVGLLALSHGQLHVEHDGESCSNSSHQQILETGEGSPSLKIAPANADFAFRFYYLIASETPGKNIFFSPLSISAAYAMLSLGACSHSRSQILEGLGFNLTELSESDVHRGFQHLLHTLNLPGHGLETRVGSALFLSHNLKFLAKFLNDTMAVYEAKLFHTNFYDTVGTIQLINDHVKKETRGKIVDLVSELKKDVLMVLVNYIYFKALWEKPFISSRTTPKDFYVDENTTVRVPMMLQDQEHHWYLHDRYLPCSVLRMDYKGDATVFFILPNQGKMREIEEVLTPEMLMRWNNLLRKRNFYKKLELHLPKFSISGSYVLDQILPRLGFTDLFSKWADLSGITKQQKLEASKSFHKATLDVDEAGTEAAAATSFAIKFFSAQTNRHILRFNRPFLVVIFSTSTQSVLFLGKVVDPTKP

SEQ ID NO: 12049 - protein, 427 aa, Homo Sapiens; identical to SEQ ID NO: 12048

SEQ ID NO: 12050 - protein, 427 aa, Homo Sapiens; identical to SEQ ID NO: 12048

SEQ ID NO: 12051 - protein, 24 aa, Homo Sapiens
MQLFLLLCLVLLSPQGASLHRHHP

SEQ ID NO: 12052 - protein, 86 aa, Homo Sapiens
MQLFLLLCLVLLSPQGASLHRHHPREMKKRVEDLHVGATVAPSSRRDFTFDLYRALASAAPSQSIFFSPVSISMSLAMLSLGAGSS

SEQ ID NO: 12053 - protein, 90 aa, Homo Sapiens
MQLFLLLCLVLLSPQGASLHRHHPREMKKRVEDLHVGATVAPSSRRDFTFDLYRALASAAPSQSIFFSPVSISMSLAMLSLGAGSSTKMQ

SEQ ID NO: 12054 - protein, 144 aa, Homo Sapiens
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDT

SEQ ID NO: 12055 - protein, 157 aa, Homo Sapiens
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADT

SEQ ID NO: 12056 - protein, 172 aa, Homo Sapiens
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQI

SEQ ID NO: 12057 - protein, 231 aa, Homo Sapiens
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVV

SEQ ID NO: 12058 - protein, 406 aa, Homo Sapiens
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRSARLNSQRLVFNRPFLMFIVDNNILFLGKVNRP

SEQ ID NO: 12059 - protein, 406 aa, Homo Sapiens; identical to SEQ ID NO: 12058

SEQ ID NO: 12060 - protein, 406 aa, Homo Sapiens; identical to SEQ ID NO: 12058

SEQ ID NO: 12061 - protein, 406 aa, Homo Sapiens; identical to SEQ ID NO: 12058

SEQ ID NO: 12062 - protein, 301 aa, Homo Sapiens
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRYFQT

SEQ ID NO: 12063 - protein, 136 aa, Homo Sapiens
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGS

SEQ ID NO: 12064 - protein, 278 aa, Homo Sapiens
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGKIVDLFSGLDSPAILVLVNYIFFKGIPTHPHLKAHPLWPGITAAKIQGTLLGKVFDSVKHIHIWESPSSPQSCWAHGHSPLTWQAPGRRTSMWTRQLW

SEQ ID NO: 12065 - protein, 405 aa, Homo Sapiens
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGKIVDLFSGLDSPAILVLVNYIFFKGTWTQPFDLASTREENFYVDETTVVKVPMMLQSSTISYLHDSELPCQLVQMNYVGNGTVFFILPDKGKMNTVIAALSRDTINRWSAGLTSSQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 12066 - protein, 415 aa, Homo Sapiens
MSPFLYLVLLVLGLHATIHCASPEGKVTACHSSQPNATLYKMSSINADFAFNLYRRFTVETPDKNIFFSPVSISAALVMLSFGACCSTQTEIVETLGFNLTDTPMVEIQHGFQHLICSLNFPKKELELQIGNALFIGKHLKPLAKFLNDVKTLYETEVFSTDFSNISAAKQEINSHVEMQTKGKVVGLIQDLKPNTIMVLVNYIHFKAQWANPFDPSKTEDSSSFLIDKTTTVQVPMMHQMEQYYHLVDMELNCTVLQMDYSKNALALFVLPKEGQMESVEAAMSSKTLKKWNRLLQKGWVDLFVPKFSISATYDLGATLLKMGIQHAYSENADFSGLTEDNGLKLSNAAHKAVLHIGEKGTEAAAVPEVELSDQPENTFLHPIIQIDRSFMLLILERSTRSILFLGKVVNPTEA

SEQ ID NO: 12067 - protein, 415 aa, Homo Sapiens; identical to SEQ ID NO: 12066

SEQ ID NO: 12068 - protein, 417 aa, Homo Sapiens
MASYLYGVLFAVGLCAPIYCVSPANAPSAYPRPSSTKSTPASQVYSLNTDFAFRLYRRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 12069 - protein, 286 aa, Homo Sapiens
MGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 12070 - protein, 337 aa, Homo Sapiens
MLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 12071 - protein, 335 aa, Homo Sapiens
MQGQGRRRGTCKDIFCSKMASYLYGVLFAVGLCAPIYCVSPANAPSAYPRPSSTKSTPASQVYSLNTDFAFRLYRRLVLETPSQNIFFSPARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 12072 - protein, 435 aa, Homo Sapiens
MQGQGRRRGTCKDIFCSKMASYLYGVLFAVGLCAPIYCVSPANAPSAYPRPSSTKSTPASQVYSLNTDFAFRLYRRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 12073 - protein, 201 aa, Homo Sapiens
MRSAGGRGEIKVRRELQPSKQVSGLTNHARTGQEKRNLQRHILFQNGILPLWSTLCCWPLCSNLLCVPGQCPQCIPPPFLHKEHPCLTGVFPQHRLCLPPIPQAGFGDPESEHLLLPCECLHFPGHALPWGPLSHQDPDSPGPGLQPHTHTRVCHPPGLPAPGSLTDCSQQRPDLEDGKCPLRQEGAAAAGKFLGQCQEAV

SEQ ID NO: 12074 - protein, 334 aa, Homo Sapiens
MRSAGGRGEIKVRRELQPSKQVSGLTNHARTGQEKRNLQRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKVS

SEQ ID NO: 12075 - protein, 113 aa, Homo Sapiens
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSA

SEQ ID NO: 12076 - protein, 132 aa, Homo Sapiens
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGE

SEQ ID NO: 12077 - protein, 161 aa, Homo Sapiens
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGEKSASFREEYIRLCQKYYSSEPQAVDFLEC

SEQ ID NO: 12078 - protein, 415 aa, Homo Sapiens
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGEKSASFREEYIRLCQKYYSSEPQAVDFLECAEEARKKINSWVKTQTKGKIPNLLPEGSVDGDTRMVLVNAVYFKGKWKTPFEKKLNGLYPFRVNSAQRTPVQMMYLREKLNIGYIEDLKAQILELPYAGDVSMFLLLPDEIADVSTGLELLESEITYDKLNKWTSKDKMAEDEVEVYIPQFKLEEHYELRSILRSMGMEDAFNKGRANFSGMSERNDLFLSEVFHQAMVDVNEEGTEAAAGTGGVMTGRTGHGGPQFVADHPFLFLIMHKITNCILFFGRFSSP

SEQ ID NO: 12079 - protein, 415 aa, Homo Sapiens; identical to SEQ ID NO: 12078

SEQ ID NO: 12080 - protein, 259 aa, Homo Sapiens
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNDLYVSDAFHKAFLEVNEEGSEAAASTAVVIAGRSLNPNRVTFKANRPFLVFIREVPLNTIIFMGRVANPCVK

SEQ ID NO: 12081 - protein, 464 aa, Homo Sapiens
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 12082 - protein, 499 aa, Homo Sapiens
MKHSLNALLIFLIITSAWGGSKGPLDQLEKGGETAQSADPQWEQLNNKNLSMPLLPADFHKENTVTNDWIPEGEEDDDYLDLEKIFSEDDDYIDIVDSLSVSPTDSDVSAGNILQLFHGKSRIQRLNILNAKFAFNLYRVLKDQVNTFDNIFIAPVGISTAMGMISLGLKGETHEQVHSILHFKDFVNASSKYEITTIHNLFRKLTHRLFRRNFGYTLRSVNDLYIQKQFPILLDFKTKVREYYFAEAQIADFSDPAFISKTNNHIMKLTKGLIKDALENIDPATQMMILNCIYFKGSWVNKFPVEMTHNHNFRLNEREVVKVSMMQTKGNFLAANDQELDCDILQLEYVGGISMLIVVPHKMSGMKTLEAQLTPRVVERWQKSMTNRTREVLLPKFKLEKNYNLVESLKLMGIRMLFDKNGNMAGISDQRIAIDLFKHQGTITVNEEGTQATTVTTVGFMPLSTQVRFTVDRPFLFLIYEHRTSCLLFMGRVANPSRS

SEQ ID NO: 12083 - protein, 499 aa, Homo Sapiens; identical to SEQ ID NO: 12082

SEQ ID NO: 12084 - protein, 402 aa, Homo Sapiens [sequence omitted]

SEQ ID NO: 12085 - protein, 42 aa, Homo Sapiens
MNWHLPLFLLASVTLPSICSHFNPLSLEELGSNTGIQVFNQI

SEQ ID NO: 12086 - protein, 87 aa, Homo Sapiens
MNWHLPLFLLASVTLPSICSHFNPLSLEELGSNTGIQVFNQIVKSRPHDNIVISPHGIASVLGMLQLGADGRTKKQLAMVMRYGVNG

SEQ ID NO: 12087 - protein, 398 aa, Homo Sapiens
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITTGSENLHVSHILQKAKIEVSEDGTKASAATTAILIARSSPPWFIVDRPFLFFIRHNPTGAVLFMGQINKP

SEQ ID NO: 12088 - protein, 397 aa, Homo Sapiens
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITRSENLHVSHILQKAKIEVSEDGTKASAATTAILIARSSPPWFIVDRPFLFFIRHNPTGAVLFMGQINKP

SEQ ID NO: 12089 - protein, 397 aa, Homo Sapiens; identical to SEQ ID NO: 12088

SEQ ID NO: 12090 - protein, 276 aa, Homo Sapiens
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKT

SEQ ID NO: 12091 - protein, 409 aa, Homo Sapiens
MSDCRSSLVEGTMNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITRSENLHVSHILQKAKIEVSEDGTKASAATTAILIARSSPPWFIVDRPFLFFIRHNPTGAVLFMGQINKP

SEQ ID NO: 12092 - protein, 48 aa, Homo Sapiens
MPPFLITLFLFHSCCLRANGHLREGMTLLKTEFALHLYQSVAACRNET

SEQ ID NO: 12093 - protein, 404 aa, Homo Sapiens
MPPFLITLFLFHSCCLRANGHLREGMTLLKTEFALHLYQSVAACRNETNFVISPAGVSLPLEILQFGAEGSTGQQLADALGYTVHDKRVKDFLHAVYATLPTSSQGTEMELACSLFVQVGTPLSPCFVEHVSWWANSSLEPADLSEPNSTAIQTSEGASRETAGGGPSEGPGGWPWEQVSAAFAQLVLVSTMSFQGTWRKRFSSTDTQILPFTCAYGLVLQVPMMHQTTEVNYGQFQDTAGHQVGVLELPYLGSAVSLFLVLPRDKDTPLSHIEPHLTASTIHLWTTSLRRARMDVFLPRFRIQNQFNLKSILNSWGVTDLFDPLKANLKGISGQDGFYVSEAIHKAKIEVLEEGTKASGATALLLLKRSRIPIFKADRPFIYFLREPNTGFVFSIGRVSNPLD

SEQ ID NO: 12094 - protein, 424 aa, Homo Sapiens
MPPFLITLFLFHSCCLRANGHLREGMTLLKTEFALHLYQSVAACRNETNFVISPAGVSLPLEILQFGAEGSTGQQLADALGYTVHDKRVKDFLHAVYATLPTSSQGTEMELACSLFVQVGTPLSPCFVEHVSWWANSSLEPADLSEPNSTAIQTSEGASRETAGGGPSEGPGGWPWEQVSAAFAQLVLVSTMSFQGTWRKRFSSTDTQILPFTCAYGLVLQVPMMHQTTEVNYGQFQDTAGHQVGVLELPYLGSAVSLFLVLPRDKDTPLSHIEPHLTASTIHLWTTSLRRARMDVFLPRFRIQNQFNLKSILNSWGVTDLFDPLKANLKGISGQDGFYVSEAIHKAKIEVLEEGTKASGATALLLLKRSRIPIFKADRPFIYFLREPNTGITVFFDRIQIIYQCLSSNKGSFVHYPLKNKHSF

SEQ ID NO: 12095 - protein, 404 aa, Homo Sapiens; identical to SEQ ID NO: 12093

SEQ ID NO: 12096 - protein, 91 aa, Homo Sapiens
MKGKLARSTKEIPDEISILLLGVAHFKGQWVTKFDSRKTSLEDFYLDEERTVRVPMMSDPKAVLRYGLDSDLSCKIAQLPLTGSMSIIFFL

SEQ ID NO: 12097 - protein, 99 aa, Homo Sapiens
MKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNL

SEQ ID NO: 12098 - protein, 128 aa, Homo Sapiens
MQALVLLLCIGALLGHSSCQNPASPPEEEEDPFFKVPVNKLAAAVSNFGYDLYRVRSSTSPTTNVLLSPLSVATALSALSLGAEQRTESIIHRALYYDLISSPDIHGTYKELLDTVTAPQKNLKSASR

SEQ ID NO: 12099 - protein, 87 aa, Homo Sapiens
MQALVLLLCIGALLGHSSCQNPASPPEEGSPDPDSTGALVEEEDPFFKVPVNKLAAAVSNFGYDLYRVRSSTSPTTNVLLSPLSVAT

SEQ ID NO: 12100 - protein, 111 aa, Homo Sapiens
MQALVLLLCIGALLGHSSCQNPASPPEEGSPDPDSTGALVEEEDPFFKVPVNKLAAAVSNFGYDLYRVRSSTSPTTNVLLSPLSVATALSALSLGAEQRTESIIHRALYYD

SEQ ID NO: 12101 - protein, 132 aa, Homo Sapiens
MQALVLLLCIGALLGHSSCQNPASPPEEGSPDPDSTGALVEEEDPFFKVPVNKLAAAVSNFGYDLYRVRSSTSPTTNVLLSPLSVATALSALSLGAEQRTESIIHRALYYDLISSPDIHGTYKELLDTVTAP

SEQ ID NO: 12102 - protein, 418 aa, Homo Sapiens
MQALVLLLCIGALLGHSSCQNPASPPEEGSPDPDSTGALVEEEDPFFKVPVNKLAAAVSNFGYDLYRVRSSTSPTTNVLLSPLSVATALSALSLGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPSPGLQPAHLTFPLDYHLNQPFIFVLRDTDTGALLFIGKILDPRGP

SEQ ID NO: 12103 - protein, 114 aa, Homo Sapiens
MQALVLLLCIGALLGHSSCQNPASPPEEGSPDPDSTGALVEEEDPFFKVPVNKLAAAVSNFGYDLYRVRSSTSPTTNVLLSPLSVATALSALSLGLMPLTYFRKISKDENSLAT

SEQ ID NO: 12104 - protein, 138 aa, Homo Sapiens
MRSAFSFSVWRTSRWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDS

SEQ ID NO: 12105 - protein, 491 aa, Homo Sapiens
MALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 12106 - protein, 491 aa, Homo Sapiens; identical to SEQ ID NO: 12105

SEQ ID NO: 12107 - protein, 255 aa, Homo Sapiens
MALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSF

SEQ ID NO: 12108 - protein, 264 aa, Homo Sapiens
MALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQH

SEQ ID NO: 12109 - protein, 427 aa, Homo Sapiens
MALLWGLLVLSWSCLQGPCSVFSPVSAMEPLGRQLTSGPNQEQVSPLTLLKLGNQVQPGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 12110 - protein, 86 aa, Homo Sapiens
AKWKTTFDPKKTRMEPFHFKNSVIKVPMMNSKKYPVAHFIDQTLKAKPWPRQTLYILGWKQDSQVSSCISTILNGKMWGSCSSPTI

SEQ ID NO: 12111 - protein, 133 aa, Homo Sapiens [sequence omitted]

SEQ ID NO: 12112 - protein, 160 aa, Homo Sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAM

SEQ ID NO: 12113 - protein, 500 aa, Homo Sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 12114 - protein, 463 aa, Homo Sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 12115 - protein, 505 aa, Homo Sapiens
MASRLTLLTLLLLLLAGFLEPQDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 12116 - protein, 43 aa, Homo Sapiens
MASRLTLLTLLLLLLAGGLGRTPKQTWRASSLTPRTSPVSTRP

SEQ ID NO: 12117 - protein, 43 aa, Homo Sapiens; identical to SEQ ID NO: 12116

SEQ ID NO: 12118 - protein, 122 aa, Homo Sapiens
MGAGPGRGGGPWAPRVGAGSEAGWLRRSADVAAQMASRLTLLTLLLLLLAGDRASSNPNATSSSSQDPESLQDRGEGKVATTVISKMLFVEPILEVSSLPTTNSTTNSATKITANTTDEPTT

SEQ ID NO: 12119 - protein, 543 aa, Homo Sapiens
MGAGPGRGGGPWAPRVGAGSEAGWLRRSADVAAQMASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSEQPSHLFPLAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 12120 - protein, 448 aa, Homo Sapiens
MLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 12121 - protein, 150 aa, Homo Sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSS

SEQ ID NO: 12122 - protein, 165 aa, Homo Sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRD

SEQ ID NO: 12123 - protein, 167 aa, Homo Sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKR

SEQ ID NO: 12124 - protein, 203 aa, Homo Sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNA

SEQ ID NO: 12125 - protein, 247 aa, Homo Sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYD

SEQ ID NO: 12126 - protein, 249 aa, Homo Sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDE

SEQ ID NO: 12127 - protein, 418 aa, Homo Sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 12128 - protein, 418 aa, Homo Sapiens; identical to SEQ ID NO: 12127

SEQ ID NO: 12129 - protein, 295 aa, Homo Sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMG

SEQ ID NO: 12130 - protein, 418 aa, Homo Sapiens; identical to SEQ ID NO: 12127

SEQ ID NO: 12131 - protein, 324 aa, Homo Sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQVRGGPA

SEQ ID NO: 12132 - protein, 142 aa, Homo Sapiens
MRSLLLLSAFCLLEAALAAEVKKPAAAAAPGTAEKLSPKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVT

SEQ ID NO: 12133 - protein, 86 aa, Homo Sapiens [sequence omitted]

SEQ ID NO: 12134 - protein, 201 aa, Homo Sapiens
MVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 12135 - protein, 56 aa, Homo Sapiens
  misc_feature (1)..(1): Xaa can be any naturally occurring amino acid
XNPFDQDIYGREELRSPKLFYADHPFIFLVRDTQSGSLLFIGRLVRPKGDKMRDEL

SEQ ID NO: 12136 - protein, 160 aa, Homo Sapiens
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTN

SEQ ID NO: 12137 - protein, 245 aa, Homo Sapiens
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTNNLVKDLVSPRDFDAATYLALINAVYFKGNWKSQFRPENTRTFSFTKDDESEVQIPMMYQQGEFYYGEFSDGSNEAGGIYQVLEIP

SEQ ID NO: 12138 - protein, 410 aa, Homo Sapiens
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTNNLVKDLVSPRDFDAATYLALINAVYFKGNWKSQFRPENTRTFSFTKDDESEVQIPMMYQQGEFYYGEFSDGSNEAGGIYQVLEIPYEGDEISMMLVLSRQEVPLATLEPLVKAQLVEEWANSVKKQKVEVYLPRFTVEQEIDLKDVLKALGITEIFIKDANLTGLSDNKEIFLSKAIHKSFLEVNEEGSEAAAVSGMIAISRMAVLYPQVIVDHPFFFLIRNRRTGTILFMGRVMHPETMNTSGHDFEEL

SEQ ID NO: 12139 - protein, 410 aa, Homo Sapiens; identical to SEQ ID NO: 12138

SEQ ID NO: 12140 - protein, 119 aa, Homo Sapiens
  misc_feature (1)..(1): Xaa can be any naturally occurring amino acid
XSRFTVEQEIDLKDVLKALGITEIFIKDANLTGLSDNKEIFLSKAIHKSFLEVNEEGSEAAAVSGMIAISRMAVLYPQVIVDHPFFFLIRNRRTGTILFMGRVMHPETMNTSGHDFEEL

SEQ ID NO: 12141 - protein, 157 aa, Homo Sapiens
MDTIFLWSLLLLFFGSQASRCSAQKNTEFAVDLYQEVSLSHKDNIIFSPLGITLVLEMVQLGAKGKAQQQIRQTLKQQETSAEKKQEFTFNLANALYLQEGFTVKEQYLHGNKEFFQSAIKLVDFQDAKACAEMISTWVERKTDGKIKDMFSGEEFG

SEQ ID NO: 12142 - protein, 206 aa, Homo Sapiens
MDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKK

SEQ ID NO: 12143 - protein, 405 aa, Homo Sapiens
MDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKKNGSTVKIPMMKALLRTKYGYFSESSLNYQVLELSYKGDEFSLIIILPAEGMDIEEVEKLITAQQILKWLSEMQEEEVEISLPRFKVEQKVDFKDVLYSLNITEIFSGGCDLSGITDSSEVYVSQVTQKVFFEINEDGSEAATSTGIHIPVIMSLAQSQFIANHPFLFIMKHNPTESILFMGRVTNPDTQEIKGRDLDSL

SEQ ID NO: 12144 - protein, 405 aa, Homo Sapiens; identical to SEQ ID NO: 12143

SEQ ID NO: 12145 - protein, 405 aa, Homo Sapiens; identical to SEQ ID NO: 12143

SEQ ID NO: 12146 - protein, 405 aa, Homo Sapiens; identical to SEQ ID NO: 12143

SEQ ID NO: 12147 - protein, 415 aa, Homo Sapiens
MIQNLMREVKMDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKKNGSTVKIPMMKALLRTKYGYFSESSLNYQVLELSYKGDEFSLIIILPAEGMDIEEVEKLITAQQILKWLSEMQEEEVEISLPRFKVEQKVDFKDVLYSLNITEIFSGGCDLSGITDSSEVYVSQVTQKVFFEINEDGSEAATSTGIHIPVIMSLAQSQFIANHPFLFIMKHNPTESILFMGRVTNPDTQEIKGRDLDSL

SEQ ID NO: 12148 - protein, 853 aa, Homo Sapiens
MGTPRAQHPPPPQLLFLILLSCPWIQGLPLKEEEILPEPGSETPTVASEALAELLHGALLRRGPEMGYLPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 12149 - protein, 809 aa, Homo Sapiens
MGTPRAQHPPPPQLLFLILLSCPWIQGLPLKEEEILPEPGSETPTVASEALAELLHGALLRRGPEMGYLPGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 12150 - protein, 910 aa, Homo Sapiens
MGTPRAQHPPPPQLLFLILLSCPWIQGLPLKEEEILPEPGSETPTVASEALAELLHGALLRRGPEMGYLPGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVTQTTDPSRQLEGGNLALAILLPLGLVIVLGSGVYIYYTKLQGKSLFGFSGSHSYSPITVESDFSNPLYEAGDTREYEVSI

SEQ ID NO: 12151 - protein, 923 aa, Homo Sapiens
MGTPRAQHPPPPQLLFLILLSCPWIQGLPLKEEEILPEPGSETPTVASEALAELLHGALLRRGPEMGYLPGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 12152 - protein, 81 aa, Homo Sapiens
MGTPRAQHPPPPQLLFLILLSCPWIQGSDRDPTLATPPAGQTLAVPSLPRATEPGTGPLTTAVTPNGVRGAGPTAPELLTP

SEQ ID NO: 12153 - protein, 879 aa, Homo Sapiens
MGTPRAQHPPPPQLLFLILLSCPWIQGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 12154 - protein, 303 aa, Homo Sapiens
  misc_feature (1)..(1): Xaa can be any naturally occurring amino acid
XCLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPA

SEQ ID NO: 12155 - protein, 314 aa, Homo Sapiens
MGIGRSEGGRRGAALGVLLALGAALLAVGSASEYDYVSFQSDIGPYQSGRFYTKPPQCVDIPADLRLCHNVGYKKMVLPNLLEHETMAEVKQQASSWVPLLNKNCHAGTQVFLCSLFAPVCLDRPIYPCRWLCEAVRDSCEPVMQFFGFYWPEMLKCDKFPEGDVCIAMTPPNATEASKPQGTTVCPPCDNELKSEAIIEHLCASEFALRMKIKEVKKENGDKKIVPKKKKPLKLGPIKKKDLKKLVLYLKNGADCPCHQLDNLSHHFLIMGRKVKSQYLLTAIHKWDKKNKEFKNFMKKMKNHECPTFQSVFK

SEQ ID NO: 12156 - protein, 178 aa, Homo Sapiens
MGWGNPIIAVFRTPFAPWLQFHWSAPFSAWLGTVLTHLHSSQQRSGTTVCPPCDNELKSEAIIEHLCASEFALRMKIKEVKKENGDKKIVPKKKKPLKLGPIKKKDLKKLVLYLKNGADCPCHQLDNLSHHFLIMGRKVKSQYLLTAIHKWDKKNKEFKNFMKKMKNHECPTFQSVFK

SEQ ID NO: 12157 - protein, 295 aa, Homo Sapiens
MLQGPGSLLLLFLASHCCLGSARGLFLFGQPDFSYKRSNCKPIPANLQLCHGIEYQNMRLPNLLGHETMKEVLEQAGAWIPLVMKQCHPDTKKFLCSLFAPVCLDDLDETIQPCHSLCVQVKDRCAPVMSAFGFPWPDMLECDRFPQDNDLCIPLASSDHLLPATEEAPKVCEACKNKNDDDNDIMETLCKNDFALKIKVKEITYINRDTKIILETKSKTIYKLNGVSERDLKKSVLWLKDSLQCTCEEMNDINAPYLVMGQKQGGELVITSVKRWQKGQREFKRISRSIRKLQC

SEQ ID NO: 12158 - protein, 346 aa, Homo Sapiens
MFLSILVALCLWLHLALGVRGAPCEAVRIPMCRHMPWNITRMPNHLHHSTQENAILAIEQYEELVDVNCSAVLRFFLCAMYAPICTLEFLHDPIKPCKSVCQRARDDCEPLMKMYNHSWPESLACDELPVYDRGVCISPEAIVTDLPEDVKWIDITPDMMVQERPLDVDCKRLSPDRCKCKKVKPTLATYLSKNYSYVIHAKIKAVQRSGCNEVTTVVDVKEIFKSSSPIPRTQVPLITNSSCQCPHILPHQDVLIMCYEWRSRMMLLENCLVEKWRDQLSKRSIQWEERLQEQRRTVQDKKKTAGRTSRSNPPKPKGKPPAPKPASPKKNIKTRSAQKRTNPKRV

SEQ ID NO: 12159 - protein, 137 aa, Homo Sapiens
MQLEQSIIPDIPAKDVKWIDITPDMMVQERPLDVDCKRLSPDRCKCKKVKPTLATYLSKNYSYVIHAKIKAVQRSGCNEVTTVVDVKEIFKSSSPIPRTQVPLITNSSCQCPHILPHQDVLIMCYEWRSRMMLLENC

SEQ ID NO: 12160 - protein, 317 aa, Homo Sapiens
MRAAAAGGGVRTAALALLLGALHWAPARCEEYDYYGWQAEPLHGRSYSKPPQCLDIPADLPLCHTVGYKRMRLPNLLEHESLAEVKQQASSWLPLLAKRCHSDTQVFLCSLFAPVCLDRPIYPCRSLCEAVRAGCAPLMEAYGFPWPEMLHCHKFPLDNDLCIAVQFGHLPATAPPVTKICAQCEMEHSADGLMEQMCSSDFVVKMRIKEIKIENGDRKLIGAQKKKKLLKPGPLKRKDTKRLVLHMKNGAGCPCPQLDSLAGSFLVMGRKVDGQLLLMAVYRWDKKNKEMKFAVKFMFSYPCSLYYPFFYGAAEPH

SEQ ID NO: 12161 - protein, 78 aa, Homo Sapiens
MGSGLPLVLLLTLLGSSHGTGPGMTLQLKLKESFLTNSSYESSFLELLEKLCLLLHLPSGTSVTLHHARSQHHVVCNT

SEQ ID NO: 12162 - protein, 55 aa, Homo Sapiens
MTLQLKLKESFLTNSSYESSFLELLEKLCLLLHLPSGTSVTLHHARSQHHVVCNT

SEQ ID NO: 12163 - protein, 263 aa, Homo Sapiens
MRPCQVPGAATGPRAMWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 12164 - protein, 158 aa, Homo Sapiens
MWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARA

SEQ ID NO: 12165 - protein, 158 aa, Homo Sapiens; identical to SEQ ID NO: 12164

SEQ ID NO: 12166 - protein, 248 aa, Homo Sapiens
MWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 12167 - protein, 248 aa, Homo Sapiens; identical to SEQ ID NO: 12166

SEQ ID NO: 12168 - protein, 38 aa, Homo Sapiens
MRPCQVPGAATGPRAMWLCPLALTLILMAASGAACEVK

SEQ ID NO: 12169 - protein, 98 aa, Homo Sapiens
MWLCPLALTLILMAASGAACEVKDVCVGSPGIPGTPGSHGLPGRDGRDGVKGDPGPPGPMGPPGETPCPPGNNGLPGAPGVPGERGEKGEAGERGPPG

SEQ ID NO: 12170 - protein, 158 aa, Homo Sapiens
MWLCPLALTLILMAASGAACEVKDVCVGSPGIPGTPGSHGLPGRDGRDGVKGDPGPPGPMGPPGETPCPPGNNGLPGAPGVPGERGEKGEAGERGPPGLPAHLDEELQATLHDFRHQILQTRGALSLQGSIMTVGEKVFSSNGQSITFDAIQEACARA

SEQ ID NO: 12171 - protein, 248 aa, Homo Sapiens
MWLCPLALTLILMAASGAACEVKDVCVGSPGIPGTPGSHGLPGRDGRDGVKGDPGPPGPMGPPGETPCPPGNNGLPGAPGVPGERGEKGEAGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 12172 - protein, 248 aa, Homo Sapiens; identical to SEQ ID NO: 12171

SEQ ID NO: 12173 - protein, 381 aa, Homo Sapiens
MAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 12174 - protein, 381 aa, Homo Sapiens; identical to SEQ ID NO: 12173

SEQ ID NO: 12175 - protein, 393 aa, Homo Sapiens
MHQAGYPGCRGAMAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 12176 - protein, 92 aa, Homo Sapiens
  misc_feature (1)..(1): Xaa can be any naturally occurring amino acid
XEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 12177 - protein, 374 aa, Homo Sapiens
  misc_feature (1)..(1): Xaa can be any naturally occurring amino acid
XHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPREWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 12178 - protein, 218 aa, Homo Sapiens
MFLSTSKHGRQEAMLLFLLSALVLLTQPLGYLEAEMKTYSHRTMPSACTLVMCSSVESGLPGRDGRDGREGPRGEKGDPGLPGAAGQAGMPGQAGPVGPKGDNGSVGEPGPKGDTGPSGPPGPPGVPGPAGREGPLGKQGNIGPQGKPGPKGEAGPKGEVGAPGMQGSAGARGLAGPKGERGVPGERGVPGNTGAAGSAGAMGPQGSPGARGPPGLKG

SEQ ID NO: 12179 - protein, 375 aa, Homo Sapiens
MLLFLLSALVLLTQPLGYLEAEMKTYSHRTMPSACTLVMCSSVESGLPGRDGRDGREGPRGEKGDPGLPGAAGQAGMPGQAGPVGPKGDNGSVGEPGPKGDTGPSGPPGPPGVPGPAGREGPLGKQGNIGPQGKPGPKGEAGPKGEVGAPGMQGSAGARGLAGPKGERGVPGERGVPGNTGAAGSAGAMGPQGSPGARGPPGLKGDKGIPGDKGAKGESGLPDVASLRQQVEALQGQVQHLQAAFSQYKKVELFPNGQSVGEKIFKTAGFVKPFTEAQLLCTQAGGQLASPRSAAENAALQQLVVAKNEAAFLSMTDSKTEGKFTYPTGESLVYSNWAPGEPNDDGGSEDCVEIFTNGKWNDRACGEKRLVVCEF

SEQ ID NO: 12180 - protein, 88 aa, Homo Sapiens
MADTATTASAAAASAASASSDAPPFQLGKPRFQQTSFYGRFRHFLDIIDPRTLFVTEMESCTVPQAHCNPCLLGSETSQRGCAAAGGL

SEQ ID NO: 12181 - protein, 340 aa, Homo Sapiens
MADTATTASAAAASAASASSDAPPFQLGKPRFQQTSFYGRFRHFLDIIDPRTLFVTERRLREAVQLLEDYKHGTLRPGVTNEQLWSAQKIKQAILHPDTNEKIFMPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVASANICNVVLMRYGELEEGIDVLDSDGNLVGSSKIAARHALLETALTRVVLPMPILVLPPIVMSMLEKTALLQARPRLLLPVQSLVCLAAFGLALPLAISLFPQMSEIETSQLEPEIAQATSSRTVVYNKGL

SEQ ID NO: 12182 - protein, 253 aa, Homo Sapiens
MADTATTASAAAASAASASSDAPPFQLGKPRFQQTSFYGRFRHFLDIIDPRTLFVTERRLREAVQLLEDYKHGTLRPGVTNEQLWSAQKIKQAILHPDTNEKIFMPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVGRLSCRHAPGCSSLCKASCAWQPSAWPCRWPSASSRKCQRLKHPN

SEQ ID NO: 12183 - protein, 156 aa, Homo Sapiens
MADTATTASAAAASAASASSDAPPFQLGKPRFQQTSFYGRFRHFLDIIDPRTLFVTERRLREAVQLLEDYKHGTLRPGVTNEQLWSAQKIKQVIFLLGRQFRSSLAQPDTGIHCLLWLNQSHNACVNYANRNATKPSPASKFIQGYLGAVISAVSI

SEQ ID NO: 12184 - protein, 252 aa, Homo Sapiens
  misc_feature (1)..(1): Xaa can be any naturally occurring amino acid
XAASAASASSDAPPFQLGKPRFQQTSFYGRFRHFLDIIDPRTLFVTERRLREAVQLLEDYKHGTLRPGVTNEQLWSAQKIKQAILHPDTNEKIFMPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVGPAGDGADASGPAHAHPGATPDRHVHAGEIETSQLEPEIAQATSSRTVVYNKGL

SEQ ID NO: 12185 - protein, 196 aa, Homo Sapiens
LRHSSGLLSSWVTAYNRDSFDTTRQRLVLEIGDPEGPLLPYQAEFLVRSHDAEEVLPSTPASRFLSALGGLWEPGELQLLNVTSALDRGGRVPLPIEGRKEGLKRDLATSDIQMVHHCTIHGNTEELRQMAASREVPRPLSTLPMFNVHTVVPGPALTSSSLLCPHHEWHIPPADSSSWPSWNPGSKQAGRGGGVG

SEQ ID NO: 12186 - protein, 65 aa, Homo Sapiens
MAETLFWTPLLVGKLGPCSAGRPRMRGQDLGVFSWQGWGTPRPSRPRYTHLWAVSLCTPWTMRRF

SEQ ID NO: 12187 - protein, 263 aa, Homo Sapiens
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGLKRDLATSDIQMVHHCTIHGNTEELRQMAASREVPRPLSTLPMFNVHTGERLPPRVDSAQVPLILDQH

SEQ ID NO: 12188 - protein, 298 aa, Homo Sapiens
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGVYIKVGSASPFSTCLKMVASPDSHARCAQGQPPLLSCYDTLAPHFRVDWCNVTLAEERPGYLRHPDGPPLHHPREHRGAAADGGQPRGAPATLHPAHVQCAHR

SEQ ID NO: 12189 - protein, 387 aa, Homo Sapiens
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGVYIKVGSASPFSTCLKMVASPDSHARCAQGQPPLLSCYDTLAPHFRVDWCNVTLVDKSVPEPADEVPTPGDGILEHDPFFCPPTEAPDRDFLVDALVTLLVPLLVALLLTLLLAYVMCCRREGRLKRDLATSDIQMVHHCTIHGNTEELRQMAASREVPRPLSTLPMFNVHTGERLPPRVDSAQVPLILDQH

SEQ ID NO: 12190 - protein, 61 aa, Homo Sapiens
MAETLFWTPLLVVLLAGLGDTEAQQTTLHPLVGRVFVHTLDHETFLSLPEHVGHSLQSGQL

SEQ ID NO: 12191 - protein, 58 aa, Homo Sapiens
  misc_feature (1)..(1): Xaa can be any naturally occurring amino acid
XCPTRCPHHLPRPPPGTPRPAPVAPLHPAQPPPPWLPLRLCHPRRSWAPGHSLQSGQL

SEQ ID NO: 12192 - protein, 160 aa, Homo Sapiens
  misc_feature (1)..(1): Xaa can be any naturally occurring amino acid
XLDRGGRVPLPIEGRKEGVYIKVDKSVPEPADEVPTPGDGILEHDPFFCPPTEAPDRDFLVDALVTLLVPLLVALLLTLLLAYVMCCRREGRLKRDLATSDIQMVHHCTIHGNTEELRQMAASREVPRPLSTLPMFNVHTGERLPPRVDSAQVPLILDQH

SEQ ID NO: 12193 - protein, 108 aa, Homo Sapiens
MSCPVPACCALLLVLGLCRARPRNALLLLADDGGFESGAYNNSAIATPHLDALARRSLLFRNAFTSVSSCSPSRASLLTGLPQAFLPLRRLPRPPPLWALPAPVRNLL

SEQ ID NO: 12194 - protein, 227 aa, Homo Sapiens
MSCPVPACCALLLVLGLCRARPRNALLLLADDGGFESGAYNNSAIATPHLDALARRSLLFRNAFTSVSSCSPSRASLLTGLPQASSGRSTWGRRPCTRLTLRTRRRMAPSSRWGGTSLELSCSSGNSCRLRMTGLSSSTSPSTTPTAVGTPSPSTEPSVRSLATERAAWVVSQTGPPRPTTHWTCWCLTSSPTPRQPEPTWPLSTPPSAAWTKELDWCSRSCVTPVS

SEQ ID NO: 12195 - protein, 502 aa, Homo Sapiens
MSCPVPACCALLLVLGLCRARPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLWATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 12196 - protein, 188 aa, Homo Sapiens [sequence omitted]

SEQ ID NO: 12197 - protein, 274 aa, Homo Sapiens
MSCPVPACCALLLVLGLCRARPRNALLLLADRALSVSHLTQRMTEALRVARTTTAPSPPRTWTPWPAAASSFAMPSPRSAAALPAAPASSLACPSIRMGCTGCTRTCTTSTPSTRCGACRCCSAKLVCAQASSGRSTWGRRPCTRLTLRTRRRMAPSSRWGGTSLELSCSSGNSCRLRMTGLSSSTSPSTTPTAVGTPSPSTEPSVRSLATERAAWVVSQTGPPRPTTHWTCWCLTSSPTPRQPEPTWPLSTPPSAAWTKELDWCSRSCVTPVS

SEQ ID NO: 12198 - protein, 110 aa, Homo Sapiens
MYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKF

SEQ ID NO: 12199 - protein, 67 aa, Homo Sapiens
VIFTSDNGIPFPSGRTNLYWPGTAEPLLVSSPEHPKRWGQVSEAYVSLLEEKNEAQRGEVSCSGLHS

SEQ ID NO: 12200 - protein, 106 aa, Homo Sapiens
  misc_feature (1)..(1): Xaa can be any naturally occurring amino acid
XARPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGGAEHH

SEQ ID NO: 12201 - protein, 194 aa, Homo Sapiens
  misc_feature (1)..(1): Xaa can be any naturally occurring amino acid
XFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLVTRLLLPTVK

SEQ ID NO: 12202 - protein, 882 aa, Homo Sapiens
MLLGASWLCASKAAAAAAQSEGDEDRPGERRRRRAAATAAGAGEDMDESSLLDLLECSVCLERLDTTAKVLPCQHTFCRRCLESIVCSRHELRCPECRILVGCGVDELPANILLVRLLDGIRQRPRAGTSPGGSPPARPIPGQSAAPTLAGGGGGAAGSTPGSPVFLSAAAGSTAGSLRELATSRTAPAAKNPCLLPYGKALYSYEGKEPGDLKFNKGDIIVLRRKVDEQWYHGELHGTQGFLPASYIQCIQPLPHAPPQGKALYDFEMKDKDQDKDCLTFTKDEILTVLRRVDENWAEGMLGDKIGIFPLLYVELNDSAKQLIEMDKPCPAAASSCNASLPSDSGAVASVAPSPTLSSSGAVSAFQRRVDGKKNTKKRHSFTALSVTHRSSQAASHRHSMEISAPVLISSSDPRAAARIGDLAHLSCAAPTQDVSSSAGSTPTAVPRAASVSGEQGTPPKVQLPLNVYLALYAYKPQKSDELELHKGEMYRVLEKCQDGWFKGASLRTGVSGVFPGNYVTPVSRVPAGGAGPPRNNVVGGSPLAKGITTTMHPGSGSLSSLATATRPALPITTPQAHAQHPTASPPTGSCLRHSAQPTASQARSTISTAAHSAAQAQDRPTATVSPLRTQNSPSRLPATSLRPHSVVSPQHSHQPPVQMCPRPAIPLTSAASAITPPNVSAANLNGEAGGGPIGVLSTSSPTNTGCKLDEKKSEKKEKKSGLLKLLAGASTKKKSRSPPSVSPTHDPQVAVDALLQGAVGPEVSSLSIHGRAGSCPIESEMQGAMGMEPLHRKAGSLDLNFTSPSRQAPLSMAAIRPEPKLLPRERYRVVVSYPPQSEAEIELKEGDIVFVHKKREDGWYKGTLQRNGRTGLFPGSFVESF

SEQ ID NO: 12203 - protein, 181 aa, Homo Sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAAPETGLWAPDQQTPSHHEDCAWGAALPRFQPSVAAGSCPGWLPAPGFLAGQTGRDLSICPH

SEQ ID NO: 12204 - protein, 384 aa, Homo Sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWAKPQGRLFLGALPGEDSSTSFCLNGLWAQGQRLDVDQALNRSHEIWTHSCPQSPGNGTDASH

SEQ ID NO: 12205 - protein, 402 aa, Homo Sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWAKPQGRLFLGALPGEDSSTSFCLNGLWAQGQRLDVDQALNRSHEIWTHSCPQSPGNGTDASH

SEQ ID NO: 12206 - protein, 293 aa, Homo Sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQEKTLPPLFA

SEQ ID NO: 12207 - protein, 287 aa, Homo Sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRGEDSSTSFCLNGLWAQGQRLDVDQALNRSHEIWTHSCPQSPGNGTDASH

SEQ ID NO: 12208 - protein, 57 aa, Homo Sapiens
MESRGPLATSRLLLLLLLLLLRHTRQGWALRPVLPTQVQERDRALSSCSLPFSPLAL

SEQ ID NO: 12209 - protein, 82 aa, Homo Sapiens
MTFDLTKITKTSSSFEVRTWDPEGVIFYGDTNPKDDWFMLGLRDGRPEIQLHNHWAQLTVGAGPRLDDGRWHQEKTLPPLFA

SEQ ID NO: 12210 - protein, 181 aa, Homo Sapiens
MTFDLTKITKTSSSFEVRTWDPEGVIFYGDTNPKDDWFMLGLRDGRPEIQLHNHWAQLTVGAGPRLDDGRWHQLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQEKTLPPLFA

SEQ ID NO: 12211 - protein, 290 aa, Homo Sapiens
MTFDLTKITKTSSSFEVRTWDPEGVIFYGDTNPKDDWFMLGLRDGRPEIQLHNHWAQLTVGAGPRLDDGRWHQLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWAKPQGRLFLGALPGEDSSTSFCLNGLWAQGQRLDVDQALNRSHEIWTHSCPQSPGNGTDASH

SEQ ID NO: 12212 - protein, 175 aa, Homo Sapiens
MTFDLTKITKTSSSFEVRTWDPEGVIFYGDTNPKDDWFMLGLRDGRPEIQLHNHWAQLTVGAGPRLDDGRWHQLVPALDGCLRRDSWLDKQAEISASAPTSLRSCDVESNPGIFLPPGTQAEFNLRGEDSSTSFCLNGLWAQGQRLDVDQALNRSHEIWTHSCPQSPGNGTDASH

SEQ ID NO: 12213 - protein, 93 aa, Homo Sapiens
MTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVL

SEQ ID NO: 12214 - protein, 235 aa, Homo Sapiens
MTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQEKTLPPLFA

SEQ ID NO: 12215 - protein, 344 aa, Homo Sapiens
MTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWAKPQGRLFLGALPGEDSSTSFCLNGLWAQGQRLDVDQALNRSHEIWTHSCPQSPGNGTDASH

SEQ ID NO: 12216 - protein, 344 aa, Homo Sapiens; identical to SEQ ID NO: 12215

SEQ ID NO: 12217 - protein, 229 aa, Homo Sapiens
MTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRGEDSSTSFCLNGLWAQGQRLDVDQALNRSHEIWTHSCPQSPGNGTDASH

SEQ ID NO: 12218 - protein, 113 aa, Homo Sapiens
WALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQEKTLPPLFA

SEQ ID NO: 12219 - protein, 212 aa, Homo Sapiens
WALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQEKTLPPLFA

SEQ ID NO: 12220 - protein, 206 aa, Homo Sapiens
WALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQLVPALDGCLRRDSWLDKQAEISASAPTSLRSCDVESNPGIFLPPGTQAEFNLRGEDSSTSFCLNGLWAQGQRLDVDQALNRSHEIWTHSCPQSPGNGTDASH

SEQ ID NO: 12221 - protein, 260 aa, Homo Sapiens
WALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRGEDSSTSFCLNGLWAQGQRLDVDQALNRSHEIWTHSCPQSPGNGTDASH

SEQ ID NO: 12222 - protein, 495 aa, Homo Sapiens
MQWSPTPGASACLGWASSLACSTAPTLLGRAGRGPLMAAKWFKEFPLNLKTVSERAKPGGGGGKLRKNSEAGGAGPGPGKGRKNSAAELGSGRAGVGPKDSRLSRDSLQGLIQAAAGKGRKNSRATEEEPHRGATKSSGCSTYINRLIKVDTQEKNGKSNYPSSSSSSSSSSSSASSSPSSLGPELDKGKIIKQQETVIILEDYADPYDAKRTKGQRDAERVGENDGYMEPYDAQQMITEIRRRGSKDPLVKALQLLDSPCEPADGGLKSETLAKRRSSKDLLGKPPQLYDTPYEPAEGGPRAEGKARPPDSRLPENDERPAAEYEQPWEWKKEQIVRALSVQFEGAERPSFREETVRQHHRQKSWTQKILKPALSDHSEGEKVDPGLPLEKQPWYHGAISRAEAESRLQPCKEAGYLVRNSESGNSRYSIALKTSQGCVHIIVAQTKDNKYTLNQTSAVFDSIPEVVHYYSNEKLPFKGAEHMTLLYPVHSKLH

SEQ ID NO: 12223 - protein, 132 aa, Homo Sapiens
  misc_feature (1)..(1): Xaa can be any naturally occurring amino acid
XEGKARPPDSRLPENDERPAAEYEQPWEWKKEQIVRALSVQFEGAERPSFREETVRQHHRQKSWTQKILKPALSDHSEGEKVDPGLPLEKQPWYHGAISRAEAESRLQPCKEAGYLVRNSESGNSRYSIALK

SEQ ID NO: 12224 - protein, 41 aa, Homo Sapiens
  misc_feature (1)..(1): Xaa can be any naturally occurring amino acid
XSRAEAESRLQPCKEAGYLVRNSESGNSRYSIALKNHHLLS

SEQ ID NO: 12225 - protein, 462 aa, Homo Sapiens
MLLLARCLLLVLVSSLLVCSGLACGPGRGFGKRRHPKKLTPLAYKQFIPNVAEKTLGASGRYEGKISRNSERFKELTPNYNPDIIFKDEENTGADRLMTQRCKDKLNALAISVMNQWPGVKLRVTEGWDEDGHHSEESLHYEGRAVDITTSDRDRSKYGMLARLAVEAGFDWVYYESKAHIHCSVKAENSVAAKSGGCFPGSATVHLEQGGTKLVKDLSPGDRVLAADDQGRLLYSDFLTFLDRDDGAKKVFYVIETREPRERLLLTAAHLLFVAPHNDSATGEPEASSGSGPPSGGALGPRALFASRVRPGQRVYVVAERDGDRRLLPAAVHSVTLSEEAAGAYAPLTAQGTILINRVLASCYAVIEEHSWAHRAFAPFRLAHALLAALAPARTDRGGDSGGGDRGGGGGRVALTAPGAADAPGAGATAGIHWYSQLLYQIGTWLLDSEALHPLGMAVKSS

SEQ ID NO: 12226 - protein, 126 aa, Homo Sapiens
MLSLFPSPGPGSSRCKDKLNALAISVMNQWPGVKLRVTEGWDEDGHHSEESLHYEGRAVDITTSDRDRSKYGMLARLAVEAGFDWVYYESKAHIHCSVKAGGQQVPGWCLQSRRKCDGFCSFDSSV

SEQ ID NO: 12227 - protein, 169 aa, Homo Sapiens
MLSLFPSPGPGSSRCKDKLNALAISVMNQWPGVKLRVTEGWDEDGHHSEESLHYEGRAVDITTSDRDRSKYGMLARLAVEAGFDWVYYESKAHIHCSVKAGKERKPLLRDTRYRASRGCSPAPPGRGADFSFRVDGAKSLCKMYAWWLLPASLMTKCISIPVKTCITMY

SEQ ID NO: 12228 - protein, 123 aa, Homo Sapiens
MLSLFPSPGPGSSRCKDKLNALAISVMNQWPGVKLRVTEGWDEDGHHSEESLHYEGRAVDITTSDRDRSKYGMLARLAVEAGFDWVYYESKAHIHCSVKAVQSDFKSVESEPEAPGTAAPLAV

SEQ ID NO: 12229 - protein, 262 aa, Homo Sapiens
KFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 12230 - protein, 141 aa, Homo Sapiens
MAAAATAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVLLLQFVACSFERSWIDLLVETSSSMVTCRHQCSQ

SEQ ID NO: 12231 - protein, 707 aa, Homo Sapiens
MAAAATAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGVFHLGVPVEALFFVGNQLIATSHTGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 12232 - protein, 682 aa, Homo Sapiens
MAAAATAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 12233 - protein, 102 aa, Homo Sapiens
MAAAATAAEGVPSRGPPGEVIHLNVGGKRFSTSRQTLTWIPDSFFSSLLSGRISTLKDETGAIFIDRDPTVFAPILNFLRTKELDPRLAWKKGRESLTVFSP

SEQ ID NO: 12234 - protein, 88 aa, Homo Sapiens
MAAAATAAEGVPSRGPPGEVIHLNVGGKRFSTSRQTLTWIPDSFFSSLLSGRISTLKDETGAIFIDRDPTVFAPILNFLRTKELDPRP

SEQ ID NO: 12235 - protein, 37 aa, Homo Sapiens
MRPEQSSSTGTLQSSPPSSTSCAPKSWIPAFSVHPHT

SEQ ID NO: 12236 - protein, 131 aa, Homo Sapiens
MRPEQSSSTGTLQSSPPSSTSCAPKSWIPVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAV

SEQ ID NO: 12237 - protein, 277 aa, Homo Sapiens
RSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 12238 - protein, 610 aa, Homo Sapiens
  misc_feature (1)..(1): Xaa can be any naturally occurring amino acid
XAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGVFHLGVPVEALFFVGNQLIATSHTGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 12239 - protein, 175 aa, Homo Sapiens
  misc_feature (1)..(1): Xaa can be any naturally occurring amino acid
XDSGNWIEIAYGTSSGGVRVIVQHPETVGSGPQLFQTFTVHRSPVTKIMLSEKHLISAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 12240 - protein, 250 aa, Homo Sapiens
  misc_feature (1)..(1): Xaa can be any naturally occurring amino acid
XELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 12241 - protein, 129 aa, Homo Sapiens
  misc_feature (1)..(1): Xaa can be any naturally occurring amino acid
XGSGPQLFQTFTVHRSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRWPDGARADGTAGTL

SEQ ID NO: 12242 - protein, 299 aa, Homo Sapiens
  misc_feature (1)..(1): Xaa can be any naturally occurring amino acid
XGSIYYVDVQKFPLRMKDNDLLVSELYRDPAEDGVTALSVYLTPKTICADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPP

SEQ ID NO: 12243 - protein, 164 aa, Homo Sapiens
  misc_feature (1)..(1): Xaa can be any naturally occurring amino acid
XQMGMAAAVLAMTLAPTVSGTTSKCSSRRWCPVPASSSCVSHLLGSAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 12244 - protein, 143 aa, Homo Sapiens
  misc_feature (1)..(1): Xaa can be any naturally occurring amino acid
XTSKCSSRRWCPVPASSSCVSHLLGSGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 12245 - protein, 523 aa, Homo Sapiens
MVAPGLVLGLVLPLILWADRSAGIGFRFASYINNDMVLQKEPAGAVIWGFGTPGATVTVTLRQGQETIMKKVTSVKAHSDTWMVVLDPMKPGGPFEVMAQQTLEKINFTLRVHDVLFGDVWLCSGQSNMQMTVLQIFNATRELSNTAAYQSVRILSVSPIQAEQELEDLVAVDLQWSKPTSENLGHGYFKYMSAVCWLFGRHLYDTLQYPIGLIASSWGGTPIEAWSSGRSLKACGVPKQGSIPYDSVTGPSKHSVLWNAMIHPLCNMTLKGVVWYQGESNINYNTDLYNCTFPALIEDWRETFHRGSQGQTERFFPFGLVQLSSDLSKKSSDDGFPQIRWHQTADFGYVPNPKMPNTFMAVAMDLCDRDSPFGSIHPRDKQTVAYRLHLGARALAYGEKNLTFEGPLPEKIELLAHKGLLNLTYYQQIQVQKKDNKIFEISCCSDHRCKWLPASMNTVSTQSLTLAIDSCHGTVVALRYAWTTWPCEYKQCPLYHPSSALPAPPFIAFITDQGPGHQSNVAK

SEQ ID NO: 12246 - protein, 488 aa, Homo Sapiens
MVLQKEPAGAVIWGFGTPGATVTVTLRQGQETIMKKVTSVKAHSDTWMVVLDPMKPGGPFEVMAQQTLEKINFTLRVHDVLFGDVWLCSGQSNMQMTVLQIFNATRELSNTAAYQSVRILSVSPIQAEQELEDLVAVDLQWSKPTSENLGHGYFKYMSAVCWLFGRHLYDTLQYPIGLIASSWGGTPIEAWSSGRSLKACGVPKQGSIPYDSVTGPSKHSVLWNAMIHPLCNMTLKGVVWYQGESNINYNTDLYNCTFPALIEDWRETFHRGSQGQTERFFPFGLVQLSSDLSKKSSDDGFPQIRWHQTADFGYVPNPKMPNTFMAVAMDLCDRDSPFGSIHPRDKQTVAYRLHLGARALAYGEKNLTFEGPLPEKIELLAHKGLLNLTYYQQIQVQKKDNKIFEISCCSDHRCKWLPASMNTVSTQSLTLAIDSCHGTVVALRYAWTTWPCEYKQCPLYHPSSALPAPPFIAFITDQGPGHQSNVAK

SEQ ID NO: 12247 - protein, 488 aa, Homo Sapiens; identical to SEQ ID NO: 12246

SEQ ID NO: 12248 - protein, 133 aa, Homo Sapiens
GIFRRILHVLYTDCIRQCSGPLYVDRMVLLVMGNVINWSLAAYGLIMRPNDFASYLLAIGICNLLLYFAFYIIMKKTPAESREHNRDCILLDFFDDHDIWHFLSSIAMFGSFLVLLTLDDDLDTVQRDKIYVF

SEQ ID NO: 12249 - protein, 170 aa, Homo Sapiens
MDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENW

SEQ ID NO: 12250 - protein, 110 aa, Homo Sapiens
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQ

SEQ ID NO: 12251 - protein, 855 aa, Homo Sapiens
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENWRQKKKTLLVAIDRACPESGHPRVLADSFPGSSPYEGYNYGSFENVSGSTDGLVDSAGTGDLSYGYQGHDQFKRRLPSGQMRQLCIAMGRSFEPVGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLCALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSIIHIIATLLLSTQLYYMGRWKLDSGIFRRILHVLYTDCIRQCSGPLYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVSGPPGRAGWVREGSSCLLLCG

SEQ ID NO: 12252 - protein, 832 aa, Homo Sapiens
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENWRQKKKTLLVAIDRACPESGHPRVLADSFPGSSPYEGYNYGSFENVSGSTDGLVDSAGTGDLSYGYQGRSFEPVGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLCALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSIIHIIATLLLSTQLYYMGRWKLDSGIFRRILHVLYTDCIRQCSGPLYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVLLTLDDDLDTVQRDKIYVF

SEQ ID NO: 12253 - protein, 829 aa, Homo Sapiens
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENWRQKKKTLLVAIDRACPESASLLGHPRVLADSFPGSSPYEGYNYGSFENVSGSTDGLVDSAGTGDLSYGYQGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLCALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSIIHIIATLLLSTQLYYMGRWKLDSGIFRRILHVLYTDCIRQCSGPLYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVLLTLDDDLDTVQRDKIYVF

SEQ ID NO: 12254 - protein, 832 aa, Homo Sapiens; identical to SEQ ID NO: 12252

SEQ ID NO: 12255 - protein, 855 aa, Homo Sapiens; identical to SEQ ID NO: 12251

SEQ ID NO: 12256 - protein, 98 aa, Homo Sapiens
MFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCSV

SEQ ID NO: 12257 - protein, 124 aa, Homo Sapiens
MRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVLLTLDDDLDTVQRDKIYVF

SEQ ID NO: 12258 - protein, 602 aa, Homo Sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKPDVYIPETLEPGQPVTVICVFNWAFEECPPPSFSWTGAALSSQGTKPTTSHFSVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 12259 - protein, 697 aa, Homo Sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKPDVYIPETLEPGQPVTVICVFNWAFEECPPPSFSWTGAALSSQGTKPTTSHFSVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 12260 - protein, 512 aa, Homo Sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKPDVYIPETLEPGQPVTVICVFNWAFEECPPPSFSWTGAALSSQGTKPTTSHFSVLSFTPRPQDHNTDLTCHVDFSRKGVSAQRTVRLRVAYAPRDLVISISRDNTPDPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 12261 - protein, 554 aa, Homo Sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTGTKPTTSHFSVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 12262 - protein, 639 aa, Homo Sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 12263 - protein, 544 aa, Homo Sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 12264 - protein, 454 aa, Homo Sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTVLSFTPRPQDHNTDLTCHVDFSRKGVSAQRTVRLRVAYAPRDLVISISRDNTPDPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 12265 - protein, 155 aa, Homo Sapiens
MLLPLLLSSLLGVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQ

SEQ ID NO: 12266 - protein, 186 aa, Homo Sapiens
MRRCYCHCCCPRCWADWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKPDVYIPETLEPGQPVTVICVFNWAFEECPPPSFSWTGAALSSQGTKPTTSHFSVLSFTPRPQDHNTDLTCHVDF

SEQ ID NO: 12267 - protein, 401 aa, Homo Sapiens
MQGAQEASASEMLPLLLPLLWAASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSSFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 12268 - protein, 437 aa, Homo Sapiens
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSSFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 12269 - protein, 389 aa, Homo Sapiens
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSWMLRRPPLSTPDAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVISTSSRQA

SEQ ID NO: 12270 - protein, 353 aa, Homo Sapiens
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWSSAPVPDRHSFRPPC

SEQ ID NO: 12271 - protein, 453 aa, Homo Sapiens
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 12272 - protein, 342 aa, Homo Sapiens
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWSSAPVPDRHSFRPPC

SEQ ID NO: 12273 - protein, 467 aa, Homo Sapiens
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTALTHRPNILIPGTLESGCFQNLTCSVPWACEQGTPPMISWMGTSVSPLHPSTTRSSVLTLIPQPQHHGTSLTCQVTLPGAGVTTNRTIQLNVSYPPQNLTVTVFQGEGTASTALGNSSSLSVLEGQSLRLVCAVDSNPPARLSWTWRSLTLYPSQPSNPLVLELQVHLGDEGEFTCRAQNSLGSQHVSLNLSLQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPK

SEQ ID NO: 12274 - protein, 185 aa, Homo Sapiens
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTAPAPRHQPHLSGDLAWGRRDHEQDHPTQCVLSPCLSVPDPP

SEQ ID NO: 12275 - protein, 374 aa, Homo Sapiens
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTDPPQNLTVTVFQGEGTASTALGNSSSLSVLEGQSLRLVCAVDSNPPARLSWTWRSLTLYPSQPSNPLVLELQVHLGDEGEFTCRAQNSLGSQHVSLNLSLQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPK

SEQ ID NO: 12276 - protein, 145 aa, Homo Sapiens
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTE

SEQ ID NO: 12277 - protein, 145 aa, Homo Sapiens
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTG

SEQ ID NO: 12278 - protein, 13 aa, Homo Sapiens
MLPLLQLGGKDNS

SEQ ID NO: 12279 - protein, 103 aa, Homo Sapiens
MLPLLQLGKSSLAAQAFVKGLIQGAIYAGIVIALLFLCLLPLIVKHIRKKQAKKAAAIRAKKSSKVRASQELEMSLKPEEPGKPVVATFSESRILEKQDKRAS

SEQ ID NO: 12280 - protein, 84 aa, Homo Sapiens
MLPLLQLVPAKLLNSSCSLEKTLQCSCSFHGIPTPSVQWWMGGVPVGVDGMDGSLQVTSTMLGPWANSTISLTEEPEMGMRLLC

SEQ ID NO: 12281 - protein, 140 aa, Homo Sapiens
MLPLLQLVPAKLLNSSCSLEKTLQCSCSFHGIPTPSVQWWMGGVPVGVDGMDGSLQVTSTMLGPWANSTISLTEEPEMGMRLLCEGKNQNGTHALSILLMSRKSSLAAQAFVKGLIQGAIYAGIVIALLFLCLLPLIVKH

SEQ ID NO: 12282 - protein, 197 aa, Homo Sapiens
MLPLLQLVPAKLLNSSCSLEKTLQCSCSFHGIPTPSVQWWMGGVPVGVDGMDGSLQVTSTMLGPWANSTISLTEEPEMGMRLLCEGKNQNGTHALSILLMSRKSSLAAQAFVKGLIQGAIYAGIVIALLFLCLLPLIVKHIRKKQAKKAAAIRAKKSSKVRASQELEMSLKPEEPGKPVVATFSESRILEKQDKRAS

SEQ ID NO: 12283 - protein, 197 aa, Homo Sapiens; identical to SEQ ID NO: 12282

SEQ ID NO: 12284 - protein, 134 aa, Homo Sapiens
MGAMCLLHASLSEYVLLFGTALGSRGHSGRYWAEISDTIISGTFHQWREGTTKSEVFYPGETVVHGPGEATAVEWGPNTWMVEYGRGVIPSTLAFALADTVFSTQDFLTLFYTLRSYARGLRLELTTYLFGQDP

SEQ ID NO: 12285 - protein, 106 aa, Homo Sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEALLG

SEQ ID NO: 12286 - protein, 192 aa, Homo Sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSGETVVHGPGEATAVEWGPNTWMVEYGRGVIPSTLAFALADTVFSTQDFLTLFYTLRSYARGLRLELTTYLFGQDP

SEQ ID NO: 12287 - protein, 223 aa, Homo Sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSGRYWAEISDTIISGTFHQWREGTTKSEVFYPGETVVHGPGEATAVEWGPNTWMVEYGRGVIPSTLAFALADTVFSTQDFLTLFYTLRSYARGLRLELTTYLFGQDP

SEQ ID NO: 12288 - protein, 83 aa, Homo Sapiens
LKSALAKFKEGAEMESSKEDKMDNAQDLLSFGGLQVVINGLNSTEPLVKEYAAFVLGAAFSSNPKVQVEAIEGGALQKLLVIL

SEQ ID NO: 12289 - protein, 95 aa, Homo Sapiens
MAPQSLPSSRMAPLGMLLGLLMAACFTFCLSHQNLKEFALTNPEKSSTKETERKETKAEEELDAEVLEVFHPTHEWQALQPGQAVPAGSHVRLNL

SEQ ID NO: 12290 - protein, 123 aa, Homo Sapiens
MAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINT

SEQ ID NO: 12291 - protein, 163 aa, Homo Sapiens
MAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRP

SEQ ID NO: 12292 - protein, 461 aa, Homo Sapiens
MAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 12293 - protein, 461 aa, Homo Sapiens; identical to SEQ ID NO: 12292

SEQ ID NO: 12294 - protein, 468 aa, Homo Sapiens
MNSGTSLTMAPQSLPSSRMAPLGMLLGLLMAACFTFCLSHQNLEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEEEAELTQEMSPEKLQQYRQVHLLPGLWEQGWCEITAHLLALPEHDAREKVLQTLGVLLTTCRDRYRQDPQLGRTLASLQAEYQVLASLELQDGEDEGYFQELLGSVNSLLKELR

SEQ ID NO: 12295 - protein, 123 aa, Homo Sapiens
MQEMSDMSLTMAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNN

SEQ ID NO: 12296 - protein, 125 aa, Homo Sapiens
MQEMSDMSLTMAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLK

SEQ ID NO: 12297 - protein, 182 aa, Homo Sapiens
GNELSDFQTNVDPAGDSVSYSIHSTARVVLTRGDVHSQVICEIAHITLQGDPLRGTANLSEAIRVPPTLEVTQQPMRAENQANVTCQVSNFYPRGLQLTWLENGNVSRTETASTLIENKDGTYNWMSWLLVNTCAHRDDVVLTCQVEHDGQQAVSKSYALEISAHQKEHGSDITHGAVTSHF

SEQ ID NO: 12298 - protein, 77 aa, Homo Sapiens
HRDDVKLTCQVEHDGQPAVSKSHDLKVSAHPKEQGSNTAPGPALASAAPLLIAFLLGPKVLLVVGVSVIYVYWKQKA

SEQ ID NO: 12299 - protein, 77 aa, Homo Sapiens; identical to SEQ ID NO: 12298

SEQ ID NO: 12300 - protein, 77 aa, Homo Sapiens; identical to SEQ ID NO: 12298

SEQ ID NO: 12301 - protein, 236 aa, Homo Sapiens
HTVSFTCESHGFSPRDITLKWFKNGNELSDFQTNVDPAGDSVSYSIHSTAKVVLTREDVHSQVICEVAHVTLQGDPLRGTANLSETIRVPPTLEVTQQPVRAENQVNVTCQVRKFYPQRLQLTWLENGNVSRTETASTLTENKDGTYNWMSWLLVNVSAHRDDVKLTCQVEHDGQPAVSKSHDLKVSAHPKEQGSNTAPGPALASAAPLLIAFLLGPKVLLVVGVSVIYVYWKQKA

SEQ ID NO: 12302 - protein, 398 aa, Homo Sapiens
MPVPASWPHLPSPFLLMTLLLGRLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVRAKPSAPVVSGPAVRATPEHTVSFTCESHGFSPRDITLKWFKNGNELSDFQTNVDPAGDSVSYSIHSTARVVLTRGDVHSQVICEIAHITLQGDPLRGTANLSEAIRVPPTLEVTQQPMRAENQANVTCQVSNFYPRGLQLTWLENGNVSRTETASTLIENKDGTYNWMSWLLVNTCAHRDDVVLTCQVEHDGQQAVSKSYALEISAHQKEHGSDITHEAALAPTAPLLVALLLGPKLLLVVGVSAIYICWKQKA

SEQ ID NO: 12303 - protein, 181 aa, Homo Sapiens
MPVPASWPHLPSPFLLMTLLLGRLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVREAALAPTAPLLVALLLGPKLLLVVGVSAIYICWKQKA

SEQ ID NO: 12304 - protein, 398 aa, Homo Sapiens
MPVPASWPHLPSPFLLMTLLLGRLTGVAGEEELQVIQPDKSISVAAGESATLHCTVTSLIPVGPIQWFRGAGPGRELIYNQKEGHFPRVTTVSDLTKRNNMDFSIRISNITPADAGTYYCVKFRKGSPDHVEFKSGAGTELSVRAKPSAPVVSGPAARATPQHTVSFTCESHGFSPRDITLKWFKNGNELSDFQTNVDPAGDSVSYSIHSTAKVVLTREDVHSQVICEVAHVTLQGDPLRGTANLSETIRVPPTLEVTQQPVRAENQVNVTCQVRKFYPQRLQLTWLENGNVSRTETASTLTENKDGTYNWMSWLLVNVSAHRDDVKLTCQVEHDGQPAVSKSHDLKVSAHPKEQGSNTAPGPALASAAPLLIAFLLGPKVLLVVGVSVIYVYWKQKA

SEQ ID NO: 12305 - protein, 398 aa, Homo Sapiens; identical to SEQ ID NO: 12304

SEQ ID NO: 12306 - protein, 156 aa, Homo Sapiens
MPVPASWPHPPCPFLLLTLLLGLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVREAALAPTAPLLVA

SEQ ID NO: 12307 - protein, 180 aa, Homo Sapiens
MPVPASWPHPPCPFLLLTLLLGLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVREAALAPTAPLLVALLLGPKLLLVVGVSAIYICWKQKA

SEQ ID NO: 12308 - protein, 58 aa, Homo Sapiens
RKGSPDHVEFKSGAGTELSVREAALAPTAPLLVALLLGPKLLLVVGVSAIYICWKQKA

SEQ ID NO: 12309 - protein, 131 aa, Homo Sapiens
  misc_feature (1)..(1): Xaa can be any naturally occurring amino acid
XPPTLEVTQQPVRAENQVNVTCQVRKFYPQRLQLTWLENGNVSRTETASTLTENKDGTYNWMSWLLVNVSAHRDDVKLTCQVEHDGQPAVSKSHDLKVSAHPKEQGSNTAPVSLEFYRRGNQDLGSNGGYC

SEQ ID NO: 12310 - protein, 198 aa, Homo Sapiens
MPIPASPLHPPLPSLLLYLLLELAGVTHVFHVQQTEMSQTVSTGESIILSCSVPNTLPNGPVLWFKGTGPNRKLIYNFKQGNFPRVKEIGDTTKPGNTDFSTRIREISLADAGTYYCVKFIKGRAIKEYQSGRGTQVFVTAEQNPRPPKNRPAGRAGSRAHHDAHTCLSALPERNSTNYFVQPCCCLRLLGLTGLLSK

SEQ ID NO: 12311 - protein, 197 aa, Homo Sapiens
MPIPASPLHPPLPSLLLYLLLELAGVTHVFHVQQTEMSQTVSTGESIILSCSVPNTLPNGPVLWFKGTGPNRKLIYNFKQGNFPRVKEIGDTTKPGNTDFSTRIREISLADAGTYYCVKFIKGRAIKEYQSGRGTQVFVTEQNPRPPKNRPAGRAGSRAHHDAHTCLSALPERNSTNYFVQPCCCLRLLGLTGLLSK

SEQ ID NO: 12312 - protein, 80 aa, Homo Sapiens
  misc_feature (1)..(1): Xaa can be any naturally occurring amino acid
XNGPVLWFKGTGPNRKLIYNFKQEQNPRPPKNRPAGRAGSRAHHDAHTCLSALPERNSTNYFVQPCCCLRLLGLTGLLSK

SEQ ID NO: 12313 - protein, 335 aa, Homo Sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGPLQKKLDSFPAQDPCTTIYVAATEPVPESVQETNSITVYASVTLPES

SEQ ID NO: 12314 - protein, 357 aa, Homo Sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRATLTTTNQYWSQNVLTQDQERCPGCLPMVKRTITRQQWKKKALRSMPKSRNQVLFRRNLTPSQLRTLAPPYMLLPQSLSQSLSRKQIPSQSMLV

SEQ ID NO: 12315 - protein, 144 aa, Homo Sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKSLHFGYLYFVLGADHDNLQT

SEQ ID NO: 12316 - protein, 149 aa, Homo Sapiens
MAGSPTCLTLIYILWQLTEHLSKPKVTMGLQSNKNGTCVTNLTCCMEHGEEDVIYTWKALGQAANESHNGSILPISWRWGESDMTFICVARNPVSRNFSSPILARKLCEENNPKGRSSKYGLLHCGNTEKDGKSPLTAHDARHTKAICL

SEQ ID NO: 12317 - protein, 188 aa, Homo Sapiens
MAGSPTCLTLIYILWQLTEHLSKPKVTMGLQSNKNGTCVTNLTCCMEHGEEDVIYTWKALGQAANESHNGSILPISWRWGESDMTFICVARNPVSRNFSSPILARKLCEEYIEEKKRVDICRETPNICPHSGENTEYDTIPHTNRTILKEDPANTVYSTVEIPKKMENPHSLLTMPDTPRLFAYENVI

SEQ ID NO: 12318 - protein, 228 aa, Homo Sapiens
MAGSPTCLTLIYILWQLTEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 12319 - protein, 241 aa, Homo Sapiens
MAGSPTCLTLIYILWQLTEHLSKPKVTMGLQSNKNGTCVTNLTCCMEHGEEDVIYTWKALGQAANESHNGSILPISWRWGESDMTFICVARNPVSRNFSSPILARKLCEGDCLSPLHRRLCPGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 12320 - protein, 335 aa, Homo Sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 12321 - protein, 296 aa, Homo Sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEENNPKGRSSKYGLLHCGNTEKDGKSPLTAHDARHTKAICL

SEQ ID NO: 12322 - protein, 165 aa, Homo Sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYENNPKGRSSKYGLLHCGNTEKDGKSPLTAHDARHTKAICL

SEQ ID NO: 12323 - protein, 204 aa, Homo Sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEYIEEKKRVDICRETPNICPHSGENTEYDTIPHTNRTILKEDPANTVYSTVEIPKKMENPHSLLTMPDTPRLFAYENVI

SEQ ID NO: 12324 - protein, 236 aa, Homo Sapiens
  misc_feature (1)..(1): Xaa can be any naturally occurring amino acid
XAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEENNPKGRSSKYGLLHCGNTE

SEQ ID NO: 12325 - protein, 532 aa, Homo Sapiens
MAGPRPPGDSPAIKEDSTGLGPTHEPFSGQPNSTSGDVLLSRRGPGHAIRPPGRAMVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNVSAITWGGGGGFVVSIHSGLAGLAPLHIQLVDAHEAPPTLIEERRDFCIKVSPAEDTPATLSADLAHFSENPILYLLLPLIFVNKCSFGCKVELEVLKGLMQSPQPMLLGLLGQFLVMPLYAFLMAKVFMLPKALALGLIITCSSPGGGGSYLFSLLLGGDVTLAISMTFLSTVAATGFLPLSSAIYSRLLSIHETLHVPISKILGTLLFIAIPIAVGVLIKSKLPKFSQLLLQVVKPFSFVLLLGGLFLAYRMGVFILAGIRLPIVLVGITVPLVGLLVGYCLATCLKLPVAQRRTVSIEVGVQNSLLALAMLQLSLRRLQADYASQAPFIVALSGTSEMLALVIGHFIYSSLFPVP

SEQ ID NO: 12326 - protein, 448 aa, Homo Sapiens
MVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNLVDAHEAPPTLIEERRDFCIKVSPAEDTPATLSADLAHFSENPILYLLLPLIFVNKCSFGCKVELEVLKGLMQSPQPMLLGLLGQFLVMPLYAFLMAKVFMLPKALALGLIITCSSPGGGGSYLFSLLLGGDVTLAISMTFLSTVAATGFLPLSSAIYSRLLSIHETLHVPISKILGTLLFIAIPIAVGVLIKSKLPKFSQLLLQVVKPFSFVLLLGGLFLAYRMGVFILAGIRLPIVLVGITVPLVGLLVGYCLATCLKLPVAQRRTVSIEVGVQNSLLALAMLQLSLRRLQADYASQAPFIVALSGTSEMLALVIGHFIYSSLFPVP

SEQ ID NO: 12327 - protein, 218 aa, Homo Sapiens
MVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNVSAITWGGGGGFVVSIHSGLAGLAPLHIQLVDAHEAPPTLIEERRDFCIKVSPAEDTPATLSADLAHFSENPILYLLLPLIFVNKCSFGCKVELEVLKG

SEQ ID NO: 12328 - protein, 477 aa, Homo Sapiens
MVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNVSAITWGGGGGFVVSIHSGLAGLAPLHIQLVDAHEAPPTLIEERRDFCIKVSPAEDTPATLSADLAHFSENPILYLLLPLIFVNKCSFGCKVELEVLKGLMQSPQPMLLGLLGQFLVMPLYAFLMAKVFMLPKALALGLIITCSSPGGGGSYLFSLLLGGDVTLAISMTFLSTVAATGFLPLSSAIYSRLLSIHETLHVPISKILGTLLFIAIPIAVGVLIKSKLPKFSQLLLQVVKPFSFVLLLGGLFLAYRMGVFILAGIRLPIVLVGITVPLVGLLVGYCLATCLKLPVAQRRTVSIEVGVQNSLLALAMLQLSLRRLQADYASQAPFIVALSGTSEMLALVIGHFIYSSLFPVP

SEQ ID NO: 12329 - protein, 477 aa, Homo Sapiens; identical to SEQ ID NO: 12328

SEQ ID NO: 12330 - protein, 43 aa, Homo Sapiens
GAIMGIFFCLSGVGSLLGSSLVALLSLPGGWLHCPKDFAEEEL

SEQ ID NO: 12331 - protein, 209 aa, Homo Sapiens
MDLGRDATRRFFNWFYWSINLGAVLSLLVVAFIQQNISFLLGYSIPVGCVGLAFFIFLFATPVFITKPPMGSQVSSMLKLALQNCCPQLWQRHSARDRQCARVLADERSPQPGASPQEDIANFQVLVKILPVMVTLVPYWMVYFQMQSTYVLQGLHLHIPNIFPANPANISVALRAQGSSYTIPEAWLLLANVVVVLILVPLKDRLIDP

SEQ ID NO: 12332 - protein, 581 aa, Homo Sapiens
MPAPRAREQPRVPGERQPLLPRGARGPRRWRRAAGAAVLLVEMLERAAFFGVTANLVLYLNSTNFNWTGEQATRAALVFLGASYLLAPVGGWLADVYLGRYRAVALSLLLYLAASGLLPATAFPDGRSSFCGEMPASPLGPACPSAGCPRSSPSPYCAPVLYAGLLLLGLAASSVRSNLTSFGADQVMDLGRDATRRFFNWFYWSINLGAVLSLLVVAFIQQNISFLLGYSIPVGCVGLAFFIFLFATPVFITKPPMGSQVSSMLKLALQNCCPQLWQRHSARDRQCARVLADERSPQPGASPQEDIANFQVLVKILPVMVTLVPYWMVYFQMQSTYVLQGLHLHIPNIFPANPANISVALRAQGSSYTIPEAWLLLANVVVVLILVPLKDRLIDPLLLRCKLLPSALQKMALGMFFGFTSVIVAGVLEMERLHYIHHNETVSQQIGEVLYNAAPLSIWWQIPQYLLIGISEIFASIPGLEFAYSEAPRSMQGAIMGIFFCLSGVGSLLGSSLVALLSLPGGWLHCPKDFGNINNCRMDLYFFLLAGIQAVTALLFVWIAGRYERASQGPASHSRFSRDRG

SEQ ID NO: 12333 - protein, 456 aa, Homo Sapiens
MPAPRAREQPRVPGERQPLLPRGARGPRRWRRAAGAAVLLVEMLERAAFFGVTANLVLYLNSTNFNWTGEQATRAALVFLGASYLLAPVGGWLADVYLGRYRAVALSLLLYLAASGLLPATAFPDGRSSFCGEMPASPLGPACPSAGCPRSSPSPYCAPVLYAGLLLLGLAASSVRSNLTSFGADQVMDLGRDATRRFFNWFYWSINLGAVLSLLVVAFIQQNISFLLGYSIPVGCVGLAFFIFLFATPVFITKPPMGSQVSSMLKLALQNCCPQLWQRHSARDRQCARVLADERSPQPGASPQEDIANFQVLVKILPVMVTLVPYWMVYFQMQSTYVLQGLHLHIPNIFPANPANISVALRAQGSSYTESWRWSAYTTSTTTRPCPSRLGRSCTTRHHCPSGGRSLSTCSLGSVRSLPASQAWSLPTQRPRAPCRAPSWASSSACRGWAHCWAPA

SEQ ID NO: 12334 - protein, 149 aa, Homo Sapiens
MPASPLGPACPSAGCPRSSPSPYCAPVLYAGLLLLGLAASSVRSNLTSFGADQVMDLGRDATRRFFNWFYWSINLGAVLSLLVVAFIQQNISFLLGYSIPVGCVGLAFFIFLFATPVFITKPPMGSQVSSMLKLALQNCCPQLWQRHSA

SEQ ID NO: 12335 - protein, 247 aa, Homo Sapiens
  misc_feature (1)..(1): Xaa can be any naturally occurring amino acid
XPGASPQEDIANFQVLVKILPVMVTLVPYWMVYFQIPEAWLLLANVVVVLILVPLKDRLIDPLLLRCKLLPSALQKMALGMFFGFTSVIVAGVLEMERLHYIHHNETVSQQIGEVLYNAAPLSIWWQIPQYLLIGISEIFASIPGLEFAYSEAPRSMQGAIMGIFFCLSGVGSLLGSSLVALLSLPGGWLHCPKDFGNINNCRMDLYFFLLAGIQAVTALLFVWIAGRYERASQGPASHSRFSRDRG

SEQ ID NO: 12336 - protein, 353 aa, Homo Sapiens
MGIFPGIILIFLRVKFATAAVIHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRCLCSKAVTGCVLWLMPVIPALWEANAGGSLEGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 12337 - protein, 353 aa, Homo Sapiens; identical to SEQ ID NO: 12336

SEQ ID NO: 12338 - protein, 322 aa, Homo Sapiens
MGIFPGIILIFLRVKFATAAVIHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 12339 - protein, 198 aa, Homo Sapiens
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWR

SEQ ID NO: 12340 - protein, 325 aa, Homo Sapiens
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 12341 - protein, 325 aa, Homo Sapiens; identical to SEQ ID NO: 12340

SEQ ID NO: 12342 - protein, 290 aa, Homo Sapiens
MSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 12343 - protein, 75 aa, Homo Sapiens
MLCLCLYVPVIGEAQTEFQYFESKGLPAELKSIFKLSVFIPSQEFSTYRQWKQCPLCTKGDLQIQGRRQKEAQAL

SEQ ID NO: 12344 - protein, 469 aa, Homo Sapiens
MLCLCLYVPVIGEAQTEFQYFESKGLPAELKSIFKLSVFIPSQEFSTYRQWKQKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 12345 - protein, 501 aa, Homo Sapiens
MLQMLWHFLASFFPRAGCHGSREGDDREVRGTPAPAWRDQMASFLGKQDGRAEATEKRPTILLVVGPAEQFPKKIVQAGDKDLDGQLDFEEFVHYLQDHEKKLRLVFKSLDKKNDGRIDAQEIMQSLRDLGVKISEQQAEKILKRIRTGHFWGPVTYMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 12346 - protein, 489 aa, Homo Sapiens
MLQMLWHFLASFFPRAGCHGSREGDDREVRGTPAPAWRDQMASFLGKQDGRAEATEKRPTILLVVGPAEQFPKKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 12347 - protein, 515 aa, Homo Sapiens
MVSSVLCRCVASPPPDAAATAASSSASSPASVGDPCGGAICGGPDHRLRLWRLFQTLDVNRDGGLCVNDLAVGLRRLGLHRTEGELQKIVQAGDKDLDGQLDFEEFVHYLQDHEKKLRLVFKSLDKKNDGRIDAQEIMQSLRDLGVKISEQQAEKILKRIRTGHFWGPVTYMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 12348 - protein, 503 aa, Homo Sapiens
MVSSVLCRCVASPPPDAAATAASSSASSPASVGDPCGGAICGGPDHRLRLWRLFQTLDVNRDGGLCVNDLAVGLRRLGLHRTEGELQKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 12349 - protein, 165 aa, Homo Sapiens
  misc_feature (1)..(1): Xaa can be any naturally occurring amino acid
XTVEERQTGMWWRHLVAGGGAGAVSRTCTAPLDRLKVLMQVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQGKAGPGQSPGRSGGADRSI

SEQ ID NO: 12350 - protein, 81 aa, Homo Sapiens
MEQQDQSMKEGRLTLVLALATLIAAFGSSFQYGYNVAAVNSPALLMQQFYNETYYGRTGEFMEDFPLTLLWSVTVSMFPFG

SEQ ID NO: 12351 - protein, 139 aa, Homo Sapiens
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICA

SEQ ID NO: 12352 - protein, 166 aa, Homo Sapiens
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVP

SEQ ID NO: 12353 - protein, 190 aa, Homo Sapiens
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVD

SEQ ID NO: 12354 - protein, 190 aa, Homo Sapiens; identical to SEQ ID NO: 12353

SEQ ID NO: 12355 - protein, 190 aa, Homo Sapiens; identical to SEQ ID NO: 12353

SEQ ID NO: 12356 - protein, 190 aa, Homo Sapiens; identical to SEQ ID NO: 12353

SEQ ID NO: 12357 - protein, 244 aa, Homo Sapiens
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVDGEFRTSREHPHPFTTTLGPLLVFQSHHHRTGLSADWSLLTGWMSLGGPSCPEPT

SEQ ID NO: 12358 - protein, 501 aa, Homo Sapiens
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 12359 - protein, 313 aa, Homo Sapiens
MALLVDRVRGHWRIAAGLLFNLLVSICIVFLNKWIYVYHGFPNMSLTLVHFVVTWLGLYICQKLDIFAPKSLPPSRLLLLALSFCGFVVFTNLSLQNNTIGTYQLAKAMTTPVIIAIQTFCYQKTFSTRIQLTLIPITLGVILNSYYDVKFNFLGMVFAALGVLVTSLYQVWVGAKQHELQVNSMQLLYYQAPMSSAMLLVAVPFFEPVFGEGGIFGPWSVSALLMVLLSGVIAFMVNLSIYWIIGNTSPVTYNMFGHFKFCITLFGGYVLFKDPLSINQALGILCTLFGILAYTHFKLSEQEGSRSKLAQRP

SEQ ID NO: 12360 - protein, 125 aa, Homo Sapiens
QAPMSSAMLLVAVPFFEPVFGEGGIFGPWSVSALSTRLECSGTIMAHCSLSLLGSSNPPASTSPVAGTTGAHQHTWLIFIFFVETEFCHVAQADLKLLSSSHLSASASRSAGITGLSHHTWPVIS

SEQ ID NO: 12361 - protein, 39 aa, Homo Sapiens
MKNVMVMILVVDTKILILIMKVNFDILEREKHHMLKIMQ

SEQ ID NO: 12362 - protein, 39 aa, Homo Sapiens; identical to SEQ ID NO: 12361

SEQ ID NO: 12363 - protein, 38 aa, Homo Sapiens
MKVHMHTKFCLICLLTFIFHHCNHCHEEHDHGPEALHR

SEQ ID NO: 12364 - protein, 126 aa, Homo Sapiens
MKVHMHTKFCLICLLTFIFHHCNHCHEEHDHGPEALHRQHRGMTELEPSKFSKQAAENEKKYYIEKLFERYGENGRLSFFGLEKLLTNLGLGERKVVEINHEDLGHDHVSHLDILAVQEGKHFHSH

SEQ ID NO: 12365 - protein, 130 aa, Homo Sapiens
MKVHMHTKFCLICLLTFIFHHCNHCHEEHDHGPEALHRQHRGMTELEPSKFSKQAAENEKKYYIEKLFERYGENGRLSFFGLEKLLTNLGLGERKVVEINHEDLGHDHVSHLDILAVQEGKHFHSHNHQH

SEQ ID NO: 12366 - protein, 831 aa, Homo Sapiens
MKVHMHTKFCLICLLTFIFHHCNHCHEEHDHGPEALHRQHRGMTELEPSKFSKQAAENEKKYYIEKLFERYGENGRLSFFGLEKLLTNLGLGERKVVEINHEDLGHDHVSHLDILAVQEGKHFHSHNHQHSHNHLNSENQTVTSVSTKRNHKCDPEKETVEVSVKSDDKHMHDHNHRLRHHHRLHHHLDHNNTHHFHNDSITPSERGEPSNEPSTETNKTQEQSDVKLPKGKRKKKGRKSNENSEVITPGFPPNHDQGEQYEHNRVHKPDRVHNPGHSHVHLPERNGHDPGRGHQDLDPDNEGELRHTRKREAPHVKNNAIISLRKDLNEDDHHHECLNVTQLLKYYGHGANSPISTDLFTYLCPALLYQIDSRLCIEHFDKLLVEDINKDKNLVPEDEANIGASAWICGIISITVISLLSLLGVILVPIINQGCFKFLLTFLVALAVGTMSGDALLHLLPHSQGGHDHSHQHAHGHGHSHGHESNKFLEEYDAVLKGLVALGGIYLLFIIEHCIRMFKHYKQQRGKQKWFMKQNTEESTIGRKLSDHKLNNTPDSDWLQLKPLAGTDDSVVSEDRLNETELTDLEGQQESPPKNYLCIEEEKIIDHSHSDGLHTIHEHDLHAAAHNHHGENKTVLRKHNHQWHHKHSHHSHGPCHSGSDLKETGIANIAWMVIMGDGIHNFSDGLAIGAAFSAGLTGGISTSIAVFCHELPHELGDFAVLLKAGMTVKQAIVYNLLSAMMAYIGMLIGTAVGQYANNITLWIFAVTAGMFLYVALVDMLPEMLHGDGDNEEHGFCPVGQFILQNLGLLFGFAIMLVIALYEDKIVFDIQF

SEQ ID NO: 12367 - protein, 831 aa, Homo Sapiens; identical to SEQ ID NO: 12366

SEQ ID NO: 12368 - protein, 202 aa, Homo Sapiens
MKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFP

SEQ ID NO: 12369 - protein, 53 aa, Homo Sapiens
MKLLLLHPAFQSCLLLTLLGLWRTTPEAHASSLGAPAISAASFLQDLIHRYGE

SEQ ID NO: 12370 - protein, 89 aa, Homo Sapiens
MKLLLLHPAFQSCLLLTLLGLWRTTPEAHASSLGAPAISAASFLQDLIHRYGEGDSLTLQQLKALLNHLDVGVGRGNVTQHVQGHRNLS

SEQ ID NO: 12371 - protein, 90 aa, Homo Sapiens
MKLLLLHPAFQSCLLLTLLGLWRTTPEAHASSLGAPAISAASFLQDLIHRYGEGDSLTLQQLKALLNHLDVGVGRGNVTQHVQGHRNLST

SEQ ID NO: 12372 - protein, 122 aa, Homo Sapiens
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTIL

SEQ ID NO: 12373 - protein, 127 aa, Homo Sapiens
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDS

SEQ ID NO: 12374 - protein, 155 aa, Homo Sapiens
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWG

SEQ ID NO: 12375 - protein, 492 aa, Homo Sapiens
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGFGFLSVSLINLASLLGVLVLPCTEKAFFSRVLTYFIALSIGTLLSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMFPEMNEVCQEDERKGSILIPFIIQNLGLLTGFTIMVVLTMYSGQIQIG

SEQ ID NO: 12376 - protein, 481 aa, Homo Sapiens
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGYGLLCVTVISLCSLLGASVVPFMKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMMEFCSVAQAGVQWCHLSSLQPLPLGLKRLSCLSLPSN

SEQ ID NO: 12377 - protein, 492 aa, Homo Sapiens
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGYGLLCVTVISLCSLLGASVVPFMKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMFPEMNEVCQEDERKGSILIPFIIQNLGLLTGFTIMVVLTMYSGQIQIG

SEQ ID NO: 12378 - protein, 492 aa, Homo Sapiens; identical to SEQ ID NO: 12377

SEQ ID NO: 12379 - protein, 184 aa, Homo Sapiens
MASLVSLELGLLLAVLVVTATASPPAGLLSLLTSGQGALDQEALGGLLNTLADRVHCANGPCGKACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMA

SEQ ID NO: 12380 - protein, 647 aa, Homo Sapiens
MASLVSLELGLLLAVLVVTATASPPAGLLSLLTSGQGALDQEALGGLLNTLADRVHCANGPCGKCLSVEDALGLGEPEGSGLPPGPVLEARYVARLSAAAVLYLSNPEGTCEDARAGLWASHADHLLALLESPKALTPGLSWLLQRMQARAAGQTPKMACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGAVTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 12381 - protein, 622 aa, Homo Sapiens
MVDVVGLERETGPRGSPWPGLPLPSLVGPAPLLTCLCPQCLSVEDALGLGEPEGSGLPPGPVLEARYVARLSAAAVLYLSNPEGTCEDARAGLWASHADHLLALLESPKALTPGLSWLLQRMQARAAGQTPKMACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGAVTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 12382 - protein, 239 aa, Homo Sapiens
MMGSPEQNHYLAQLFGLYGENGTLTAGGLARLLHSLGLGRVQGLRLGQHGPLTGRAASPAADNSTHRPQNPELSVDVWAGMPLGPSGWGDLEESKAPHLPRGPAPSGLDLLHRLLLLDHSLADHLNEDCLNGSQLLVNFGLSPAAPLTPRQFALLCPALLYQIDSRVCIGAPAPAPPGDLLSALLQSALAVLLLSLPSPLSLLLLRLLGPRLLRPLLGFLGALAVGTLCGDALLHLLPH

SEQ ID NO: 12383 - protein, 123 aa, Homo Sapiens
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEES

SEQ ID NO: 12384 - protein, 126 aa, Homo Sapiens
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAP

SEQ ID NO: 12385 - protein, 129 aa, Homo Sapiens
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAPHLP

SEQ ID NO: 12386 - protein, 156 aa, Homo Sapiens
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAPHLPRGPAPSGLDLLHRLLLLDHSLADHLNE

SEQ ID NO: 12387 - protein, 540 aa, Homo Sapiens
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAPHLPRGPAPSGLDLLHRLLLLDHSLADHLNEDCLNGSQLLVNFGLSPAAPLTPRQFALLCPALLYQIDSRVCIGAPAPAPPGDLLSALLQSALAVLLLSLPSPLSLLLLRLLGPRLLRPLLGFLGALAVGTLCGDALLHLLPHAQEGRHAGPGGLPEKDLGPGLSVLGGLFLLFVLENMLGLLRHRGLRPRCCRRKRRNLETRNLDPENGSGMALQPLQAAPEPGAQGQREKNSQHPPALAPPGHQGHSHGHQGGTDITWMVLLGDGLHNLTDGLAIGAAFSDGFSSGLSTTLAVFCHELPHELGDFAMLLQSGLSFRRLLLLSLVSGALGLGGAVLGVGLSLGPVPLTPWVFGVTAGVFLYVALVDMLPALLRPPEPLPTPHVLLQGLGLLLGGGLMLAITLLEERLLPVTTEG

SEQ ID NO: 12388 - protein, 540 aa, Homo Sapiens; identical to SEQ ID NO: 12387

SEQ ID NO: 12389 - protein, 685 aa, Homo Sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVQKTQPRSALKLYQDLSLLHANELLLNRGWFCHLRNDSHYVVYTRELDGIDRIFIVVLNFGESTLLNLHNMISGLPAKMRIRLSTNSADKGSKVDTSGIFLDKGEGLIFEHNTKNLLHRQTAFRDRCFVSNRACYSSVLNILYTSC

SEQ ID NO: 12390 - protein, 564 aa, Homo Sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVSISENFMLILETKKWVSTESTHSP

SEQ ID NO: 12391 - protein, 564 aa, Homo Sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDSCSVTHARVQWRDLGTLQPLLPGFK

SEQ ID NO: 12392 - protein, 502 aa, Homo Sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDIVS

SEQ ID NO: 12393 - protein, 391 aa, Homo Sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRLTTAYALISSQA

SEQ ID NO: 12394 - protein, 552 aa, Homo Sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVILLRHPCSSAVA

SEQ ID NO: 12395 - protein, 184 aa, Homo Sapiens
MGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVSISENFMLILETKKWVSTESTHSP

SEQ ID NO: 12396 - protein, 407 aa, Homo Sapiens
MKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVQKTQPRSALKLYQDLSLLHANELLLNRGWFCHLRNDSHYVVYTRELDGIDRIFIVVLNFGESTLLNLHNMISGLPAKMRIRLSTNSADKGSKVDTSGIFLDKGEGLIFEHNTKNLLHRQTAFRDRCFVSNRACYSSVLNILYTSC

SEQ ID NO: 12397 - protein, 143 aa, Homo Sapiens
MSGMFLSSKLTTILLLFTNKSLDPGQKIQENTLLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFR

SEQ ID NO: 12398 - protein, 316 aa, Homo Sapiens
MTLNLVNSYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVQKTQPRSALKLYQDLSLLHANELLLNRGWFCHLRNDSHYVVYTRELDGIDRIFIVVLNFGESTLLNLHNMISGLPAKMRIRLSTNSADKGSKVDTSGIFLDKGEGLIFEHNTKNLLHRQTAFRDRCFVSNRACYSSVLNILYTSC

SEQ ID NO: 12399 - protein, 340 aa, Homo Sapiens
MEPGRTQIKLDPRYTADLLEVLKTNYGIPSACFSQPPTAAQLLRALGPVELALTSILTLLALGSIAIFLEDAVYLYKNTLCPIKRRTLLWKSSAPTVVSVLCCFGLWIPRSLVLVEMTITSFYAVCFYLLMLVMVEGFGGKEAVLRTLRDTPMMVHTGPCCCCCPCCPRLLLTRKKLQLLMLGPFQYAFLKITLTLVGLFLVPDGIYDPADISEGSTALWINTFLGVSTLLALWTLGIISRQARLHLGEQNMGAKFALFQVLLILTALQPSIFSVLANGGQIACSPPYSSKTRSQVMNCHLLILETFLMTVLTRMYYRRKDHKVGYETFSSPDLDLNLKA

SEQ ID NO: 12400 - protein, 58 aa, Homo Sapiens
MEPGRTQIKLDPRYTADLLEVLKTNYGIPSACFSQPPTAAQLLRDRVWLCGPGWSAVV

SEQ ID NO: 12401 - protein, 66 aa, Homo Sapiens
MLLILMLSLSFNEQASHPAPGPHLPAPPALPHPGACGIAGENAAMEPGRTQIKLDPRYTADLLEVL

SEQ ID NO: 12402 - protein, 23 aa, Homo Sapiens
QARLHLGEQNMGAKFALFQQQHG

SEQ ID NO: 12403 - protein, 212 aa, Homo Sapiens
  misc_feature (1)..(1): Xaa can be any naturally occurring amino acid
XACFSQPPTAAQLLRALGPVELALTSILTLLALGSIAIFLEDAVYLYKNTLCPIKRRTLLWKSSAPTLATFKERCLECVGFASCVLAAKGFRSLRVSLPPSPAPAPSEQVVSVLCCFGLWIPRSLVLVEMTITSFYAVCFYLLMLVMVEGFGGKEAVLRTLRDTPMMVHTGPCCCCCPCCPRLLLTRKKLQLLMLGPFQYAFLKITLTLVGL

SEQ ID NO: 12404 - protein, 175 aa, Homo Sapiens
MAAPTPARPVLTHLLVALFGMGSWAAVNGIWVELPVVVKELPEAAAFQGLLLLLPPPPSVPTGELGSGLQVGAPGAEEEVEESSPLQEPPSQAAGTTPGPDPKAYQLLSARSACLLGLLAATNALTNGVLPAVQSFSCLPYGRLAYHLAVVLGSAANPLACFLAMGVLCRSLAGL

SEQ ID NO: 12405 - protein, 111 aa, Homo Sapiens
MAAPTPARPVLTHLLVALFGMGSWAAVNGIWVELPVVVKELPEGAVVGAVSWRVLLREGGSQLPAAWRGPAGIAGSRRGHPGGLSARRCCYVPPDQHLSRVPQQKGLCRPL

SEQ ID NO: 12406 - protein, 69 aa, Homo Sapiens
MAAPTPARPVLTHLLVALFGMGSWAAVNGIWVELPVVVKELPEGWSLPSYVSVLVALGNLGLLVVTLWR

SEQ ID NO: 12407 - protein, 87 aa, Homo Sapiens
MAAPTPARPVLTHLLVALFGMGSWAAVNGIWVELPVVVKELPEGWSLPSYVSVLVALGNLGLLVVTLWRRLAPGKDEQVPIRVVQGS

SEQ ID NO: 12408 - protein, 172 aa, Homo Sapiens
MAAPTPARPVLTHLLVALFGMGSWAAVNGIWVELPVVVKELPEGWSLPSYVSVLVALGNLGLLVVTLWRRLAPGKDEQVPIRVVQVLGMVGTALLASLWHHVAPVAGQLHSVAFLALAFVLALACCASNVTFLPFLSHLPPRFLRSFFLGQGLSALLPCVLALVQGVGRLEC

SEQ ID NO: 12409 - protein, 445 aa, Homo Sapiens
MAAPTPARPVLTHLLVALFGMGSWAAVNGIWVELPVVVKELPEGWSLPSYVSVLVALGNLGLLVVTLWRRLAPGKDEQVPIRVVQVLGMVGTALLASLWHHVAPVAGQLHSVAFLALAFVLALACCASNVTFLPFLSHLPPRFLRSFFLGQGLSALLPCVLALVQGVGRLECPPAPINGTPGPPLDFLERFPASTFFWALTALLVASAAAFQGLLLLLPPPPSVPTGELGSGLQVGAPGAEEEVEESSPLQEPPSQAAGTTPGPDPKAYQLLSARSACLLGLLAATNALTNGVLPAVQSFSCLPYGRLAYHLAVVLGSAANPLACFLAMGVLCRSLAGLGGLSLLGVFCGGYLMALAVLSPCPPLVGTSAGVVLVVLSWVLCLGVFSYVKVAASSLLHGGGRPALLAAGVAIQVGSLLGAVAMFPPTSIYHVFHSRKDCADPCDS

SEQ ID NO: 12410 - protein, 445 aa, Homo Sapiens; identical to SEQ ID NO: 12409

SEQ ID NO: 12411 - protein, 445 aa, Homo Sapiens; identical to SEQ ID NO: 12409

SEQ ID NO: 12412 - protein, 445 aa, Homo Sapiens; identical to SEQ ID NO: 12409

SEQ ID NO: 12413 - protein, 445 aa, Homo Sapiens; identical to SEQ ID NO: 12409

SEQ ID NO: 12414 - protein, 445 aa, Homo Sapiens; identical to SEQ ID NO: 12409

SEQ ID NO: 12415 - protein, 27 aa, Homo Sapiens
MSVGVSTSAPLSPTSGTSVGMSTFSIM

SEQ ID NO: 12416 - protein, 39 aa, Homo Sapiens
MSVGVSTSAPLSPTSGTSVGMSTFSIMDYVVFVLLLVLS

SEQ ID NO: 12417 - protein, 59 aa, Homo Sapiens
MSVGVSTSAPLSPTSGTSVGMSTFSIMDYVVFVLLLVLSLAIGLYHACRGWGRHTVGEL

SEQ ID NO: 12418 - protein, 78 aa, Homo Sapiens
MSVGVSTSAPLSPTSGTSVGMSTFSIMDYVVFVLLLVLSLAIGLYHACRGWGRHTVGELLMADRKMGCLPVALSLLAT

SEQ ID NO: 12419 - protein, 115 aa, Homo Sapiens
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAH

SEQ ID NO: 12420 - protein, 133 aa, Homo Sapiens
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYL

SEQ ID NO: 12421 - protein, 147 aa, Homo Sapiens
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTV

SEQ ID NO: 12422 - protein, 153 aa, Homo Sapiens
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQM

SEQ ID NO: 12423 - protein, 193 aa, Homo Sapiens
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQMVIYMGVVLYAPSLALNAVTGFDLWLSVLALGIVCTVYTAL

SEQ ID NO: 12424 - protein, 635 aa, Homo Sapiens
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQMVIYMGVVLYAPSLALNAVTGFDLWLSVLALGIVCTVYTALGGLKAVIWTDVFQTLVMFLGQLAVIIVGSAKVGGLGRVWAVASQHGRISGFELDPDPFVRHTFWTLAFGGVFMMLSLYGVNQAQVQRYLSSRTEKAAVLSCYAVFPFQQVSLCVGCLIGLVMFAYYQEYPMSIQQAQAAPDQFVLYFVMDLLKGLPGLPGLFIACLFSGSLSTISSAFNSLATVTMEDLIRPWFPEFSEARAIMLSRGLAFGYGLLCLGMAYISSQMGPVLQAAISIFGMVGGPLLGLFCLGMFFPCANPPGAVVGLLAGLVMAFWIGIGSIVTSMGSSMPPSPSNGSSFSLPTNLTVATVTTLMPLTTFSKPTGLQRFYSLSYLWYSAHNSTTVIVVGLIVSLLTGRMRGRSLNPATIYPVLPKLLSLLPLSCQKRLHCRSYGQDHLDTGLFPEKPRNGVLGDSRDKEAMALDGTAYQGSSSTCILQETSL

SEQ ID NO: 12425 - protein, 635 aa, Homo Sapiens; identical to SEQ ID NO: 12424

SEQ ID NO: 12426 - protein, 574 aa, Homo Sapiens
MFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFLQAQVHRRLPQNPLHFASLPERNVLLHQLPQRGGVPEHDPPTPPSPARTYGPQVRVREVPRARRQRSPNPAPLWAPPSPKPHPCSAAGPLGWDCPFRNCQSLALSSARLLADSDAGGPETRQWEPGP

SEQ ID NO: 12427 - protein, 522 aa, Homo Sapiens
MMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQPLHPDKAQIPIVGSNGSSRLQDSRI

SEQ ID NO: 12428 - protein, 134 aa, Homo Sapiens
MSGGDTRAAIARPRMAAAHGPVAPSSPEQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVV

SEQ ID NO: 12429 - protein, 652 aa, Homo Sapiens
MSGGDTRAAIARPRMAAAHGPVAPSSPEQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQPLHPDKAQIPIVGSNGSSRLQDSRI

SEQ ID NO: 12430 - protein, 706 aa, Homo Sapiens
MSGGDTRAAIARPRMAAAHGPVAPSSPEQVTLLPVQRSFFLPPFSGATPSTSLAESVLKVWHGAYNSGLLPQLMAQHSLAMAQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQPLHPDKAQIPIVGSNGSSRLQDSRI

SEQ ID NO: 12431 - protein, 633 aa, Homo Sapiens
MVGKGAKGMLNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQPLHPDKAQIPIVGSNGSSRLQDSRI

SEQ ID NO: 12432 - protein, 579 aa, Homo Sapiens
MVGKGAKGMLNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGEHSSLRPPATRPLARPLCPAGLLTPHLSRAPELLPGHPDDAGIPTTPLLSDLLALRLSRHHLPPGSGPPPPPPESSSLRVAPGAERAPPPAPTARGSAGA

SEQ ID NO: 12433 - protein, 116 aa, Homo Sapiens
MVGKGAKGMLVTLLPVQRSFFLPPFSGATPSTSLAESVLKVWHGAYNSGLLPQLMAQHSLAMAQNGAVPSEATKRDQNLKRGNWGNQIEFVLTSVGYAVGLGNVWRFPYLCYRNGG

SEQ ID NO: 12434 - protein, 664 aa, Homo Sapiens
MRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLVEMSEKKGRSLPLEYLTVRNMRKSAVSPLCLRNQNG

SEQ ID NO: 12435 - protein, 73 aa, Homo Sapiens
MYNMRRLSLSPTFSMGFHLLVTVSLLFSHVDHVIAETEMEGEGNETGECTGSYYCKKGVILPIWEPQDPSFGD

SEQ ID NO: 12436 - protein, 87 aa, Homo Sapiens
MYNMRRLSLSPTFSMGFHLLVTVSLLFSHVDHVIAETEMEGEGNETGECTGSYYCKKGVILPIWEPQDPSFGDKIARATVYFVAMVY

SEQ ID NO: 12437 - protein, 87 aa, Homo Sapiens; identical to SEQ ID NO: 12436

SEQ ID NO: 12438 - protein, 973 aa, Homo Sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLVEMSEKKALLLNELGGFTITGKYLFGQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 12439 - protein, 968 aa, Homo Sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLVEMSEKKALLLNELGGFTITGQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 12440 - protein, 937 aa, Homo Sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKIITIRIFDREEYEKECSFSLVLEEPKWIRRGMKGGFTITDEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 12441 - protein, 937 aa, Homo Sapiens; identical to SEQ ID NO: 12440

SEQ ID NO: 12442 - protein, 965 aa, Homo Sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKIITIRIFDREEYEKECSFSLVLEEPKWIRRGMKGGFTITGKYLFGQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 12443 - protein, 973 aa, Homo Sapiens; identical to SEQ ID NO: 12438

SEQ ID NO: 12444 - protein, 937 aa, Homo Sapiens; identical to SEQ ID NO: 12440

SEQ ID NO: 12445 - protein, 937 aa, Homo Sapiens; identical to SEQ ID NO: 12440

SEQ ID NO: 12446 - protein, 99 aa, Homo Sapiens
MAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 12447 - protein, 103 aa, Homo Sapiens
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLY

SEQ ID NO: 12448 - protein, 131 aa, Homo Sapiens
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAIST

SEQ ID NO: 12449 - protein, 231 aa, Homo Sapiens
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWAL

SEQ ID NO: 12450 - protein, 584 aa, Homo Sapiens
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWALGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 12451 - protein, 584 aa, Homo Sapiens; identical to SEQ ID NO: 12450

SEQ ID NO: 12452 - protein, 528 aa, Homo Sapiens
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 12453 - protein, 53 aa, Homo Sapiens
MAGRRLNLRWALSVLCVLLMAETVSGTRGSSTGAHISPQFPASVPQGVWPECL

SEQ ID NO: 12454 - protein, 53 aa, Homo Sapiens; identical to SEQ ID NO: 12453

SEQ ID NO: 12455 - protein, 143 aa, Homo Sapiens
MTVGENEGVDDQGGWGKRLTTAGPSCSCADAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 12456 - protein, 404 aa, Homo Sapiens
  misc_feature (1)..(1): Xaa can be any naturally occurring amino acid
XTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWALGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKTRRMQVAGKTKRHGA

SEQ ID NO: 12457 - protein, 701 aa, Homo Sapiens
MARRGWRRAPLRRGVGSSPRARRLMRPLWLLLAVGVFDWAGASDGGGGEARAMDEEIVSEKQAEESHRQDSANLLIFILLLTLTILTIWLFKHRRARFLHETGLAMIYGLLVGLVLRYGIHVPSDVNNVTLSCEVQSSPTTLLVNVSGKFYEYMLKGEISSHELNNVQDNEMLRKVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 12458 - protein, 669 aa, Homo Sapiens
MARRGWRRAPLRRGVGSSPRARRLMRPLWLLLAVGVFDWAGASDGGGGEARAMDEEIVSEKQAEESHRQDSANLLIFILLLTLTILTIWLFKHRRARFLHETGLAMIYGLLVGLVLRYGIHVPSDVNNVTLSCEVQSSPTTLLVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 12459 - protein, 184 aa, Homo Sapiens
MDEEIVSEKQAEESHRQDSANLLIFILLLTLTILTIWLFKHRRARFLHETGLAMIYGLLVGLVLRYGIHVPSDVNNVTLSCEVQSSPTTLLVNVSGKFYEYMLKGEISSHELNNVQDNEMLRKVTFDPEVFFNILLPPIIFYAGYSLKRRHFFRNLGSILAYAFLGTAISCFVIGSIMYGCVTL

SEQ ID NO: 12460 - protein, 649 aa, Homo Sapiens
MDEEIVSEKQAEESHRQDSANLLIFILLLTLTILTIWLFKHRRARFLHETGLAMIYGLLVGLVLRYGIHVPSDVNNVTLSCEVQSSPTTLLVNVSGKFYEYMLKGEISSHELNNVQDNEMLRKVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 12461 - protein, 649 aa, Homo Sapiens; identical to SEQ ID NO: 12460

SEQ ID NO: 12462 - protein, 649 aa, Homo Sapiens; identical to SEQ ID NO: 12460

SEQ ID NO: 12463 - protein, 679 aa, Homo Sapiens
MDEEIVSEKQAEESHRQDSANLLIFILLLTLTILTIWLFKHRRARFLHETGLAMIYGLLVGLVLRYGIHVPSDVNNVTLSCEVQSSPTTLLVNVSGKFYEYMLKGEISSHELNNVQDNEMLRKVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRYCARLWGYRDELRHGLYPQGTHSLFGETDRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 12464 - protein, 649 aa, Homo Sapiens; identical to SEQ ID NO: 12460

SEQ ID NO: 12465 - protein, 649 aa, Homo Sapiens; identical to SEQ ID NO: 12460

SEQ ID NO: 12466 - protein, 617 aa, Homo Sapiens
MDEEIVSEKQAEESHRQDSANLLIFILLLTLTILTIWLFKHRRARFLHETGLAMIYGLLVGLVLRYGIHVPSDVNNVTLSCEVQSSPTTLLVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 12467 - protein, 170 aa, Homo Sapiens
MLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 12468 - protein, 33 aa, Homo Sapiens
  misc_feature (1)..(1): Xaa can be any naturally occurring amino acid
XAMLSCLHIRVGVDSDQEHLKGPQLFLNHRSYL

SEQ ID NO: 12469 - protein, 32 aa, Homo Sapiens
MENGTQILRPTQDPSECTKEVKSLMWVYVLVG

SEQ ID NO: 12470 - protein, 538 aa, Homo Sapiens
MENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFAGIPAPIYFGALMDSTCLHWGTLKCGESGACRIYDSTTFRYIYLGLPAALRGSSFVPALIILILLRKCHLPGENASSGTELIETKVKGKENECKDIYQKSTVLKDDELKTKL

SEQ ID NO: 12471 - protein, 93 aa, Homo Sapiens
MFLTKNCKQEQERVESAKMFLLAITCAFVSKTLSGSYMNSMLTQIERQFNIPTSLVGFINGSFEIDMNMNLQFQFQATCPQTVSCVWKMEPRF

SEQ ID NO: 12472 - protein, 71 aa, Homo Sapiens
MFLTKNCKQEQERVESAKMFLLAITCAFVSKTLSGSYMNSMLTQIERQFNIPTSLVGFINGSFEIGNLLLI

SEQ ID NO: 12473 - protein, 13 aa, Homo Sapiens
MGETEKRIETHRI

SEQ ID NO: 12474 - protein, 51 aa, Homo Sapiens
MGETEKRIETHRIRCLSKLKMFLLAITCAFVSKTLSGSYMNSMLTQIERQF

SEQ ID NO: 12475 - protein, 95 aa, Homo Sapiens
MGETEKRIETHRIRCLSKLKMFLLAITCAFVSKTLSGSYMNSMLTQIERQFNIPTSLVGFINGSFEIDMNMNLQFQFQATCPQTVSCVWKMEPRF

SEQ ID NO: 12476 - protein, 88 aa, Homo Sapiens
MGETEKRIETHRIRCLSKLKMFLLAITCAFVSKTLSGSYMNSMLTQIERQFNIPTSLVGFINGSFEIGNLLLIIFVSYFGTKLHRPIM

SEQ ID NO: 12477 - protein, 91 aa, Homo Sapiens
MGETEKRIETHRIRCLSKLKMFLLAITCAFVSKTLSGSYMNSMLTQIERQFNIPTSLVGFINGSFEIGNLLLIIFVSYFGTKLHRPIMIGI

SEQ ID NO: 12478 - protein, 99 aa, Homo Sapiens
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLG

SEQ ID NO: 12479 - protein, 137 aa, Homo Sapiens
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGT

SEQ ID NO: 12480 - protein, 147 aa, Homo Sapiens
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPS

SEQ ID NO: 12481 - protein, 670 aa, Homo Sapiens
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFAGIPAPIYFGALMDSTCLHWGTLKCGESGACRIYDSTTFRYIYLGLPAALRGSSFVPALIILILLRKCHLPGENASSGTELIETKVKGKENECKDIYQKSTVLKDDELKTKL

SEQ ID NO: 12482 - protein, 782 aa, Homo Sapiens [sequence omitted]

SEQ ID NO: 12483 - protein, 1534 aa, Homo Sapiens
MALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLDLSENAIQAIPRKAFRGATDLKNLQLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRIDLSNNQIAEIAPDAFQGLRSLNSLVLYGNKITDLPRGVFGGLYTLQLLLLNANKINCIRPDAFQDLQNLSLLSLYDNKIQSLAKGTFTSLRAIQTLHLAQNPFICDCNLKWLADFLRTNPIETSGARCASPRRLANKRIGQIKSKKFRCSAKEQYFIPGTEDYQLNSECNSDVVCPHKCRCEANVVECSSLKLTKIPERIPQSTAELRLNNNEISILEATGMFKKLTHLKKINLSNNKVSEIEDGAFEGAASVSELHLTANQLESIRSGMFRGLDGLRTLMLRNNRISCIHNDSFTGLRNVRLLSLYDNQITTVSPGAFDTLQSLSTLNLLANPFNCNCQLAWLGGWLRKRKIVTGNPRCQNPDFLRQIPLQDVAFPDFRCEEGQEEGGCLPRPQCPQECACLDTVVRCSNKHLRALPKGIPKNVTELYLDGNQFTLVPGQLSTFKYLQLVDLSNNKISSLSNSSFTNMSQLTTLILSYNALQCIPPLAFQGLRSLRLLSLHGNDISTLQEGIFADVTSLSHLAIGANPLYCDCHLRWLSSWVKTGYKEPGIARCAGPQDMEGKLLLTTPAKKFECQGPPTLAVQAKCDLCLSSPCQNQGTCHNDPLEVYRCACPSGYKGRDCEVSLDSCSSGPCENGGTCHAQEGEDAPFTCSCPTGFEGPTCGVNTDDCVDHACANGGVCVDGVGNYTCQCPLQYEGKACEQLVDLCSPDLNPCQHEAQCVGTPDGPRCECMPGYAGDNCSENQDDCRDHRCQNGAQCMDEVNSYSCLCAEGYSGQLCEIPPHLPAPKSPCEGTECQNGANCVDQGNRPVCQCLPGFGGPECEKLLSVNFVDRDTYLQFTDLQNWPRANITLQVSTAEDNGILLYNGDNDHIAVELYQGHVRVSYDPGSYPSSAIYSAETINDGQFHTVELVAFDQMVNLSIDGGSPMTMDNFGKHYTLNSEAPLYVGGMPVDVNSAAFRLWQILNGTGFHGCIRNLYINNELQDFTKTQMKPGVVPGCEPCRKLYCLHGICQPNATPGPMCHCEAGWVGLHCDQPADGPCHGHKCVHGQCVPLDALSYSCQCQDGYSGALCNQAGALAEPCRGLQCLHGHCQASGTKGAHCVCDPGFSGELCEQESECRGDPVRDFHQVQRGYAICQTTRPLSWVECRGSCPGQGCCQGLRLKRRKFTFECSDGTSFAEEVEKPTKCGCALCA

SEQ ID NO: 12484 - protein, 1461 aa, Homo Sapiens
MALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLDLSENAIQAIPRKAFRGATDLKNLQLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRIDLSNNQIAEIAPDAFQGLRSLNSLVLYGNKITDLPRGVFGGLYTLQLLLLNANKINCIRPDAFQDLQNLSLLSLYDNKIQSLAKGTFTSLRAIQTLHLAQNPFICDCNLKWLADFLRTNPIETSGARCASPRRLANKRIGQIKSKKFRCSAKEQYFIPGTEDYQLNSECNSDVVCPHKCRCEANVVECSSLKLTKIPERIPQSTAELRLNNNEISILEATGMFKKLTHLKKINLSNNKVSEIEDGAFEGAASVSELHLTANQLESIRSGMFRGLDGLRTLMLRNNRISCIHNDSFTGLRNVRLLSLYDNQITTVSPGAFDTLQSLSTLNLLANPFNCNCQLAWLGGWLRKRKIVTGNPRCQNPDFLRQIPLQDVAFPDFRCEEGQEEGGCLPRPQCPQECACLDTVVRCSNKHLRALPKGIPKNVTELYLDGNQFTLVPGQLSTFKYLQLVDLSNNKISSLSNSSFTNMSQLTTLILSYNALQCIPPLAFQGLRSLRLLSLHGNDISTLQEGIFADVTSLSHLAIGANPLYCDCHLRWLSSWVKTGYKEPGIARCAGPQDMEGKLLLTTPAKKFECQGPPTLAVQAKCDLCLSSPCQNQGTCHNDPLEVYRCACPSGYKGRDCEVSLDSCSSGPCENGGTCHAQEGEDAPFTCSCPTGFEGPTCGVNTDDCVDHACANGGVCVDGVGNYTCQCPLQYEGKACEQLVDLCSPDLNPCQHEAQCVGTPDGPRCECMPGYAGDNCSENQDDCRDHRCQNGAQCMDEVNSYSCLCAEGYSGQLCEIPPHLPAPKSPCEGTECQNGANCVDQGNRPVCQCLPGFGGPECEKLLSVNFVDRDTYLQFTDLQNWPRANITLQVSTAEDNGILLYNGDNDHIAVELYQGHVRVSYDPGSYPSSAIYSAETINDGQFHTVELVAFDQMVNLSIDGGSPMTMDNFGKHYTLNSEAPLYVGGMPVDVNSAAFRLWQILNGTGFHGCIRNLYINNELQDFTKTQMKPGVVPGCEPCRKLYCLHGICQPNATPGPMCHCEAGWVGLHCDQPADGPCHGHKCVHGQCVPLDALSYSCQCQDGYSGALCNQSPSAGGTLSGTFTRSRGAMPSARPRAPCHGWSAGARAQARAAARAFG

SEQ ID NO: 12485 - protein, 409 aa, Homo Sapiens
MALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLDLSENAIQAIPRKAFRGATDLKNLQLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRIDLSNNQIAEIAPDAFQGLRSLNSLHTGPVTCPHTTGTHSSHCRAFAVAVPHSRNDLEAMFEEEVPRIFYSA

SEQ ID NO: 12486 - protein, 146 aa, Homo Sapiens
MEAVLFVNAEAAAPRQSGRPRDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNN

SEQ ID NO: 12487 - protein, 1439 aa, Homo Sapiens
MENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSARHGGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 12488 - protein, 1542 aa, Homo Sapiens
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSDEEEGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSAKEQYFIPGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTAANLNEVEKGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 12489 - protein, 1529 aa, Homo Sapiens
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSAKEQYFIPGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 12490 - protein, 1521 aa, Homo Sapiens
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 12491 - protein, 1525 aa, Homo Sapiens
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSDEEEGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 12492 - protein, 212 aa, Homo Sapiens
MTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGLPGPCGFLIPGPVDVNILAKCNPCLSNPCKNDGTCNSDPVDFYRCTCPYGFKGQDCDVPIHACISNPCKHGGTCHLKEGEEDGFWCICADGFEGENCEVNVD

SEQ ID NO: 12493 - protein, 196 aa, Homo Sapiens
  misc_feature (1)..(1): Xaa can be any naturally occurring amino acid
XSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGTNNRKYFAFHQYICLKASLELCYICLVNLFLFDKW

SEQ ID NO: 12494 - protein, 82 aa, Homo Sapiens
  misc_feature (1)..(1): Xaa can be any naturally occurring amino acid
XSYDTGSHPASAIYSVETINDGNFHIVELLALDQSLSLSVDGGNPKIITNLSKQSTLNFDSPLYVGGMPGKSNVASLRQGAL

SEQ ID NO: 12495 - protein, 1530 aa, Homo Sapiens
MAPGWAGVGAAVRARLALALALASVLSGPPAVACPTKCTCSAASVDCHGLGLRAVPRGIPRNAERLDLDRNNITRITKMDFAGLKNLRVLHLEDNQVSVIERGAFQDLKQLERLRLNKNKLQVLPELLFQSTPKLTRLDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIVKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKVLWFCCPGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 12496 - protein, 1523 aa, Homo Sapiens
MAPGWAGVGAAVRARLALALALASVLSGPPAVACPTKCTCSAASVDCHGLGLRAVPRGIPRNAERLDLDRNNITRITKMDFAGLKNLRVLHLEDNQVSVIERGAFQDLKQLERLRLNKNKLQVLPELLFQSTPKLTRLDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIVKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 12497 - protein, 1393 aa, Homo Sapiens
RDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIVKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKVLWFCCPGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 12498 - protein, 163 aa, Homo Sapiens
MKPSIAEMLHRGRMLWIILLSTIALGWTTPIPLIEDSEEIDEPCFDPCYCEVKESLFHIHCDSKGFTNISQITEFWSRPFKLYLQRNSMRKLYTNSFLHLNNAVSINLGNNALQDIQTGAFNGLKILKRLYLHENKLDVFRNDTFLGLESLEYLQADYNVIKR

SEQ ID NO: 12499 - protein, 977 aa, Homo Sapiens
MKPSIAEMLHRGRMLWIILLSTIALGWTTPIPLIEDSEEIDEPCFDPCYCEVKESLFHIHCDSKGFTNISQITEFWSRPFKLYLQRNSMRKLYTNSFLHLNNAVSINLGNNALQDIQTGAFNGLKILKRLYLHENKLDVFRNDTFLGLESLEYLQADYNVIKRIESGAFRNLSKLRVLILNDNLIPMLPTNLFKAVSLTHLDLRGNRLKVLFYRGMLDHIGRSLMELQLEENPWNCTCEIVQLKSWLERIPYTALVGDITCETPFHFHGKDLREIRKTELCPLLSDSEVEASLGIPHSSSSKENAWPTKPSSMLSSVHFTASSVEYKSSNKQPKPTKQPRTPRPPSTSQALYPGPNQPPIAPYQTRPPIPIICPTGCTCNLHINDLGLTVNCKERGFNNISELLPRPLNAKKLYLSSNLIQKIYRSDFWNFSSLDLLHLGNNRISYVQDGAFINLPNLKSLFLNGNDIEKLTPGMFRGLQSLHYLYFEFNVIREIQPAAFSLMPNLKLLFLNNNLLRTLPTDAFAGTSLARLNLRKNYFLYLPVAGVLEHLNAIVQIDLNENPWDCTCDLVPFKQWIETISSVSVVGDVLCRSPENLTHRDVRTIELEVLCPEMLHVAPAGESPAQPGDSHLIGAPTSASPYEFSPPGGPVPLSVLILSLLVLFFSAVFVAAGLFAYVLRRRRKKLPFRSKRQEGVDLTGIQMQCHRLFEDGGGGGGGSGGGGRPTLSSPEKAPPVGHVYEYIPHPVTQMCNNPIYKPREEEEVAVSSAQEAGSAERGGPGTQPPGMGEALLGSEQFAETPKENHSNYRTLLEKEKEWALAVSSSQLNTIVTVNHHHPHHPAVGGVSGVVGGTGGDLAGFRHHEKNGGVVLFPPGGGCGSGSMLLDRERPQPAPCTVGFVDCLYGTVPKLKELHVHPPGMQYPDLQQDARLKETLLFSAGKGFTDHQTQKSDYLELRAKLQTKPDYLEVLEKTTYRF

SEQ ID NO: 12500 - protein, 977 aa, Homo Sapiens; identical to SEQ ID NO: 12499

SEQ ID NO: 12501 - protein, 132 aa, Homo Sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKA

SEQ ID NO: 12502 - protein, 600 aa, Homo Sapiens
GKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 12503 - protein, 100 aa, Homo Sapiens
GVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 12504 - protein, 89 aa, Homo Sapiens
MAAATGAVAASAASGQAEGKKITDLRVIDLKSELKRRNLDITGVKTVLISRLKQAIEEEGGDPDNIELTVSTDTPNKKPTKGKDYKLKH

SEQ ID NO: 12505 - protein, 1034 aa, Homo Sapiens
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 12506 - protein, 229 aa, Homo Sapiens
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDSEASKPKDGQDAIAQSPEKESKDYEMNANHKD

SEQ ID NO: 12507 - protein, 453 aa, Homo Sapiens
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKK

SEQ ID NO: 12508 - protein, 192 aa, Homo Sapiens
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDGEEEENEKDIAGSGDGTQEVSKPLPSEGSLAEADHTAHEEMEAHTTVKEAEDDNISVTIQAEDAITLDFDGDDLLETGKNVKITDS

SEQ ID NO: 12509 - protein, 177 aa, Homo Sapiens
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKEIEAQEGEDDTFLTAQDGEEEENEKALQRNLKTARHHLKMTKEVQVVLVVAVEAQLKISGLVDFHLIPKLLI

SEQ ID NO: 12510 - protein, 161 aa, Homo Sapiens
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKEIEAQEGEDDTFLTAQDGEEEENEKEGSLAEADHTAHEEMEAHTTVKEAEDDNISV

SEQ ID NO: 12511 - protein, 62 aa, Homo Sapiens
MAAATGAVAASAASGQAEGKKITDLRVIDLKSELKRRNLDITGVKTVLISRLKQVKNMKQMS

SEQ ID NO: 12512 - protein, 62 aa, Homo Sapiens; identical to SEQ ID NO: 12511

SEQ ID NO: 12513 - protein, 62 aa, Homo Sapiens; identical to SEQ ID NO: 12511

SEQ ID NO: 12514 - protein, 205 aa, Homo Sapiens
  misc_feature (1)..(1): Xaa can be any naturally occurring amino acid
XDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKALQRNLKTARHHLKMTKEVQVVLVVAVEAQLKISGLVDFHLIPKLLI

SEQ ID NO: 12515 - protein, 112 aa, Homo Sapiens
  misc_feature (1)..(1): Xaa can be any naturally occurring amino acid
XLRYEQEKRNSLKRPRDVDHSKYFSSRRDDPYWSENKKLSLDTDARFGHGSDYSRQQNRFNDFDHRERGRFPESSAVQSSSFERRDRFVGQSEGKKARPTARREDPSFERYP

SEQ ID NO: 12516 - protein, 103 aa, Homo Sapiens
MASRWAVQLLLVAAWSMGCGEALKCYTCKEPMTSASCRTITRCKPEDTACMTTLVTVEAEYPFNQSPVVTRSCSSSCVATDPDSIGAAHLIFCCFRDLCNSEL

SEQ ID NO: 12517 - protein, 57 aa, Homo Sapiens
AAAQPPAAAVPGPSVPQPAPGQPSPVLQLQQKQSRISPIQKPQGLDPVEILQEREYR

SEQ ID NO: 12518 - protein, 37 aa, Homo Sapiens
AEGGESALGPDGECFVEGVRGKNHWPIDESSQMSDLP

SEQ ID NO: 12519 - protein, 68 aa, Homo Sapiens
MAIEDGNLEEMEEEVRLKKRKRRRNVDKDPAKEDVEKAKKRRGRPPAEKLSPNPPKLTKQMNAIIDTV

SEQ ID NO: 12520 - protein, 254 aa, Homo Sapiens
MEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 12521 - protein, 254 aa, Homo Sapiens; identical to SEQ ID NO: 12520

SEQ ID NO: 12522 - protein, 149 aa, Homo Sapiens
MEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSAR

SEQ ID NO: 12523 - protein, 169 aa, Homo Sapiens
MEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEE

SEQ ID NO: 12524 - protein, 192 aa, Homo Sapiens
MEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDD

SEQ ID NO: 12525 - protein, 202 aa, Homo Sapiens
MEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKK

SEQ ID NO: 12526 - protein, 236 aa, Homo Sapiens
MEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 12527 - protein, 260 aa, Homo Sapiens
MIINISHVWCCGEMKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 12528 - protein, 62 aa, Homo Sapiens
MKGTGMRPPHPGMGPPQSPMDQHSQGYMSPHPSPLGAPEHVSSPMSGGGPTPPQMPPSQPGA

SEQ ID NO: 12529 - protein, 244 aa, Homo Sapiens
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIK

SEQ ID NO: 12530 - protein, 245 aa, Homo Sapiens
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKL

SEQ ID NO: 12531 - protein, 200 aa, Homo Sapiens
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESED

SEQ ID NO: 12532 - protein, 228 aa, Homo Sapiens
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLN

SEQ ID NO: 12533 - protein, 229 aa, Homo Sapiens
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNK

SEQ ID NO: 12534 - protein, 276 aa, Homo Sapiens
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 12535 - protein, 276 aa, Homo Sapiens; identical to SEQ ID NO: 12534

SEQ ID NO: 12536 - protein, 98 aa, Homo Sapiens
MKRLAARCFAGLLILSPLTVISDSRPADSGKCCWLWFKASVCRPSKTAIWRKWKRKYGLRSEKDEEMWIKILQKKMWKKLRREEAALPLRNCHQIPPN

SEQ ID NO: 12537 - protein, 98 aa, Homo Sapiens; identical to SEQ ID NO: 12536

SEQ ID NO: 12538 - protein, 98 aa, Homo Sapiens; identical to SEQ ID NO: 12536

SEQ ID NO: 12539 - protein, 232 aa, Homo Sapiens [sequence omitted]

SEQ ID NO: 12540 - protein, 278 aa, Homo Sapiens
MLMKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 12541 - protein, 5 aa, Homo Sapiens
MSTPT

SEQ ID NO: 12542 - protein, 7 aa, Homo Sapiens
MSTPTDP

SEQ ID NO: 12543 - protein, 9 aa, Homo Sapiens
MSTPTDPGA

SEQ ID NO: 12544 - protein, 193 aa, Homo Sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLA

SEQ ID NO: 12545 - protein, 215 aa, Homo Sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGL

SEQ ID NO: 12546 - protein, 1590 aa, Homo Sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 12547 - protein, 1572 aa, Homo Sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 12548 - protein, 1590 aa, Homo Sapiens; identical to SEQ ID NO: 12546

SEQ ID NO: 12549 - protein, 1514 aa, Homo Sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 12550 - protein, 1572 aa, Homo Sapiens; identical to SEQ ID NO: 12547

SEQ ID NO: 12551 - protein, 1428 aa, Homo Sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDRCNVEKVPSNSQLEIEGNRKGFVIISTGA

SEQ ID NO: 12552 - protein, 279 aa, Homo Sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGRLIRNQMNNAMVQLG

SEQ ID NO: 12553 - protein, 288 aa, Homo Sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSALNAGNSNLKTPADSVSGEGLLPDS

SEQ ID NO: 12554 - protein, 279 aa, Homo Sapiens; identical to SEQ ID NO: 12552

SEQ ID NO: 12555 - protein, 288 aa, Homo Sapiens; identical to SEQ ID NO: 12553

SEQ ID NO: 12556 - protein, 183 aa, Homo Sapiens [sequence omitted]

SEQ ID NO: 12557 - protein, 248 aa, Homo Sapiens
MWLAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 12558 - protein, 271 aa, Homo Sapiens
  misc_feature (1)..(1): Xaa can be any naturally occurring amino acid
XEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDERVSVADWD

SEQ ID NO: 12559 - protein, 270 aa, Homo Sapiens
  misc_feature (1)..(1): Xaa can be any naturally occurring amino acid
XLNLQAADTVVIFDSDWNPHQEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVL

SEQ ID NO: 12560 - protein, 228 aa, Homo Sapiens
  misc_feature (1)..(1): Xaa can be any naturally occurring amino acid
XNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKVDLNEEETILIIRRLHKVLRPFLLRRLKKEVESQLPEKVEYVIKCDMSA

SEQ ID NO: 12561 - protein, 58 aa, Homo Sapiens
  misc_feature (1)..(1): Xaa can be any naturally occurring amino acid
XPFPSSLFFPDQLMKRLAARCFAGLLILSPLTVISDSRPADSGHRRRQFGGNGRGSTA

SEQ ID NO: 12562 - protein, 38 aa, Homo Sapiens
  misc_feature (1)..(1): Xaa can be any naturally occurring amino acid
XSGRQLSEVFIQLPSRKELPEYYELIRKPVDFKKIKDS

SEQ ID NO: 12563 - protein, 1419 aa, Homo Sapiens
MAEGLERVRISASELRGILATLAPQAGSRENMKELKEARPRKDNRRPDLEIYKPGLSRLRNKPKIKEPPGSEEFKDEIVNDRDCSAVENGTQPVKDVCKELNNQEQNGPIDPENNRGQESFPRTAGQEDRSLKIIKRTKKPDLQIYQPGRRLQTVSKESASRVEEEEVLNQVEQLRVEEDECRGNVAKEEVANKPDRAEIEKSPGGGRVGAAKGEKGKRMGKGEGVRETHDDPARGRPGSAKRYSRSDKRRNRYRTRSTSSAGSNNSAEGAGLTDNGCRRRRQDRTKERPRLKKQVSVSSTDSLDEDRIDEPDGLGPRRSSERKRHLERNWSGRGEGEQKNSAKEYRGTLRVTFDAEAMNKESPMVRSARDDMDRGKPDKGLSSGGKGSEKQESKNPKQELRGRGRGILILPAHTTLSVNSAGSPESAPLGPRLLFGSGSKGSRSWGRGGTTRRLWDPNNPDQKPALKTQTPQLHFLDTDDEVSPTSWGDSRQAQASYYKFQNSDNPYYYPRTPGPASQYPYTGYNPLQYPVGPTNGVYPGPYYPGYPTPSGQYVCSPLPTSTMSPEEVEQHMRNLQQQELHRLLRVADNQELQLSNLLSRDRISPEGLEKMAQLRAELLQLYERCILLDIEFSDNQNVDQILWKNAFYQVIEKFRQLVKDPNVENPEQIRNRLLELLDEGSDFFDSLLQKLQVTYKFKLEDYMDGLAIRSKPLRKTVKYALISAQRCMICQGDIARYREQASDTANYGKARSWYLKAQHIAPKNGRPYNQLALLAVYTRRKLDAVYYYMRSLAASNPILTAKESLMSLFEETKRKAEQMEKKQHEEFDLSPDQWRKGKKSTFRHVGDDTTRLEIWIHPSHPRSSQGTESGKDSEQENGLGSLSPSDLNKRFILSFLHAHGKLFTRIGMETFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 12564 - protein, 119 aa, Homo Sapiens
METFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVK

SEQ ID NO: 12565 - protein, 123 aa, Homo Sapiens
METFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSD

SEQ ID NO: 12566 - protein, 162 aa, Homo Sapiens
METFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTA

SEQ ID NO: 12567 - protein, 163 aa, Homo Sapiens
METFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAV

SEQ ID NO: 12568 - protein, 164 aa, Homo Sapiens
METFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVN

SEQ ID NO: 12569 - protein, 511 aa, Homo Sapiens
METFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 12570 - protein, 511 aa, Homo Sapiens; identical to SEQ ID NO: 12569

SEQ ID NO: 12571 - protein, 115 aa, Homo Sapiens
MFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILE

SEQ ID NO: 12572 - protein, 124 aa, Homo Sapiens
MFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFV

SEQ ID NO: 12573 - protein, 139 aa, Homo Sapiens
MFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKT

SEQ ID NO: 12574 - protein, 208 aa, Homo Sapiens
MTGPCIRQLSLQILFPLCVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELE

SEQ ID NO: 12575 - protein, 49 aa, Homo Sapiens
MIGDILLFGTLLMNAGAVLNFKLKKKDTQGFGEESREPSTGCSALESQR

SEQ ID NO: 12576 - protein, 49 aa, Homo Sapiens; identical to SEQ ID NO: 12575

SEQ ID NO: 12577 - protein, 49 aa, Homo Sapiens; identical to SEQ ID NO: 12575

SEQ ID NO: 12578 - protein, 49 aa, Homo Sapiens; identical to SEQ ID NO: 12575

SEQ ID NO: 12579 - protein, 75 aa, Homo Sapiens
MIGDILLFGTLLMNAGAVLNFKLKKKDTQGFGEESREPSTGDNIREFLLSLRYFRIFIALWNIFMMFCMIVLFGS

SEQ ID NO: 12580 - protein, 75 aa, Homo Sapiens; identical to SEQ ID NO: 12579

SEQ ID NO: 12581 - protein, 75 aa, Homo Sapiens; identical to SEQ ID NO: 12579

SEQ ID NO: 12582 - protein, 75 aa, Homo Sapiens; identical to SEQ ID NO: 12579

SEQ ID NO: 12583 - protein, 75 aa, Homo Sapiens; identical to SEQ ID NO: 12579

SEQ ID NO: 12584 - protein, 75 aa, Homo Sapiens; identical to SEQ ID NO: 12579

SEQ ID NO: 12585 - protein, 103 aa, Homo Sapiens
MIGDILLFGTLLMNAGAVLNFKLKKKDTQGFGEESREPSTGDNIREFLLSLRYFRIFIALWNIFMMFCMIVLRKLKQIAFPSSTGAITLILLLTNCEICCKWI

SEQ ID NO: 12586 - protein, 103 aa, Homo Sapiens; identical to SEQ ID NO: 12585

SEQ ID NO: 12587 - protein, 103 aa, Homo Sapiens; identical to SEQ ID NO: 12585

SEQ ID NO: 12588 - protein, 47 aa, Homo Sapiens
MIGDILLFGTLLMNAGAVLNFKLKKKDTQGFGEESREPSTGLERESD

SEQ ID NO: 12589 - protein, 56 aa, Homo Sapiens
MIGDILLFGTLLMNAGAVLNFKLKKKDTQGFGEESREPSTGWSAVVRSWLTADSTS

SEQ ID NO: 12590 - protein, 63 aa, Homo Sapiens
MNAGAVLNFKLKKKDTQGFGEESREPSTGDNIREFLLSLRYFRIFIALWNIFMMFCMIVLFGS

SEQ ID NO: 12591 - protein, 63 aa, Homo Sapiens; identical to SEQ ID NO: 12590

SEQ ID NO: 12592 - protein, 435 aa, Homo Sapiens
MLPARCARLLTPHLLLVLVQLSPARGHRTTGPRFLISDRDPQCNLHCSRTQPKPICASDGRSYESMCEYQRAKCRDPTLGVVHRGRCKDAGQSKCRLERAQALEQAKKPQEAVFVPECGEDGSFTQVQCHTYTGYCWCVTPDGKPISGSSVQNKTPVCSGSVTDKPLSQGNSGRKDDGSKPTPTMETQPVFDGDEITAPTLWIKHLVIKDSKLNNTNIRNSEKVYSCDQERQSALEEAQQNPREGIVIPECAPGGLYKPVQCHQSTGYCWCVLVDTGRPLPGTSTRYVMPSCESDARAKTTEADDPFKDRELPGCPEGKKMEFITSLLDALTTDMVQAINSAAPTGGGRFSEPDPSHTLEERVVHWYFSQLDSNSSNDINKREMKPFKRYVKKKAKPKKCARRFTDYCDLNKDKVISLPELKGCLGVSKEVGRLV

SEQ ID NO: 12593 - protein, 434 aa, Homo Sapiens
MLPARCARLLTPHLLLVLVQLSPARGHRTTGPRFLISDRDPQCNLHCSRTQPKPICASDGRSYESMCEYQRAKCRDPTLGVVHRGRCKDAGQSKCRLERAQALEQAKKPQEAVFVPECGEDGSFTQVQCHTYTGYCWCVTPDGKPISGSSVQNKTPVCSGSVTDKPLSQGNSGRKDDGSKPTPTMETQPVFDGDEITAPTLWIKHLVIKDSKLNNTNIRNSEKVYSCDQERQSALEEAQQNPREGIVIPECAPGGLYKPVQCHQSTGYCWCVLVDTGRPLPGTSTRYVMPSCESDARAKTTEADDPFKDRELPGCPEGKKMEFITSLLDALTTDMVQAINSAAPTGGGRFSEPDPSHTLEERVVHWYFSQLDSNSSNDINKREMKPFKRYVKKKAKPKKCARRFTDYCDLNKDKVISLPELKGCLGVSKEGRLV

SEQ ID NO: 12594 - protein, 67 aa, Homo Sapiens
GKKEIKPFKRFLRKKSKPKKCVKKFVEYCDVNNDKSISVQELMGCLGVAKEDGKADTKKRHRSKRNL

SEQ ID NO: 12595 - protein, 84 aa, Homo Sapiens
KKSKPKKCVKKFVEYCDVNNDKSISVQELMGCLGVAKEDGKADTKKRHTPRGHAESTSNRQDAMVVSSRPKATTHRKSRTLSRR

SEQ ID NO: 12596 - protein, 446 aa, Homo Sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 12597 - protein, 457 aa, Homo Sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTVSLQIFSVLNSDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 12598 - protein, 136 aa, Homo Sapiens
MVGGCLGGSKSSHSAWEGPILPKCKSSRGVTELANRLVCLVFLLHVDIILLILLPGPPQGYRKVKSSPEPIMSSLLTEGTAGYVVPPGLVLAAGGGAGSPRFLSAFLNASRVRELANGKFIRVALAEKDRSGMPTQ

SEQ ID NO: 12599 - protein, 453 aa, Homo Sapiens
MALVRALVCCLLTAWHCRSGLGLPVAPAGGRNPPPAIGQFWHVTDLHLDPTYHITDDHTKVCASSKGANASNPGPFGDVLCDSPYQLILSAFDFIKNSGQEASFMIWTGDSPPHVPVPELSTDTVINVITNMTTTIQSLFPNLQVFPALGNHDYWPQDQLPVVTSKVYNAVANLWKPWLDEEAISTLRKGGFYSQKVTTNPNLRIISLNTNLYYGPNIMTLNKTDPANQFEWLESTLNNSQQNKEKVYIIAHVPVGYLPSSQNITAMREYYNEKLIDIFQKYSDVIAGQFYGHTHRDSIMVLSDKKGSPVNSLFVAPAVTPVKSVLEKQTNNPGIRLFQYDPRDYKLLDMLQYYLNLTEANLKGESIWKLEYILTQTYDIEDLQPESLYGLAKQFTILDSKQFIKYYNYFFVSYDSSVTCDKTCKAFQICAIMNLDNISYADCLKQLYIKHNY

SEQ ID NO: 12600 - protein, 322 aa, Homo Sapiens
MTTTIQSLFPNLQVFPALGNHDYWPQDQLPVVTSKVYNAVANLWKPWLDEEAISTLRKGGFYSQKVTTNPNLRIISLNTNLYYGPNIMTLNKTDPANQFEWLESTLNNSQQNKEKVYIIAHVPVGYLPSSQNITAMREYYNEKLIDIFQKYSDVIAGQFYGHTHRDSIMVLSDKKGSPVNSLFVAPAVTPVKSVLEKQTNNPGIRLFQYDPRDYKLLDMLQYYLNLTEANLKGESIWKLEYILTQTYDIEDLQPESLYGLAKQFTILDSKQFIKYYNYFFVSYDSSVTCDKTCKAFQICAIMNLDNISYADCLKQLYIKHNY

SEQ ID NO: 12601 - protein, 269 aa, Homo Sapiens
MRLLAWLIFLANWGGARAEPEEAQGPCAQEKGKGPPPTSILASLAPGLEAGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPDTKVYAALGNHDFHPKNQFPAGSNNIYNQIAELWKPWLSNESIALFKKGAFYCEKLPGPSGAGRIVVLNTNLYYTSNALTADMADPGQQFQWLEDVLTDASKAGDMVYIVGHVPP

SEQ ID NO: 12602 - protein, 102 aa, Homo Sapiens
MRLLAWLIFLANWGGARAEPGKFWHIADLHLDPDYKVSKDPFQVCPSAGSQPVPDAGPWGDYLCDSPWALINSSIYAMKEIEPEPDFILWTGAVPSFSSAAS

SEQ ID NO: 12603 - protein, 455 aa, Homo Sapiens
MRLLAWLIFLANWGGARAEPGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPDTKVYAALGNHDFHPKNQFPAGSNNIYNQIAELWKPWLSNESIALFKKGAFYCEKLPGPSGAGRIVVLNTNLYYTSNALTADMADPGQQFQWLEDVLTDASKAGDMVYIVGHVPPGFFEKTQNKAWFREGFNEKYLKVVRKHHRVIAGQFFGHHHTDSFRMLYDDAGVPISAMFITPGVTPWKTTLPGVVNGANNPAIRVFEYDRATLSLKDMVTYFMNLSQANAQGTPRWELEYQLTEAYGVPDASAHSMHTVLDRIAGDQSTLQRYYVYNSVSYSAGVCDEACSMQHVCAMRQVDIDAYTTCLYASGTTPVPQLPLLLMALLGLCTLVL

SEQ ID NO: 12604 - protein, 373 aa, Homo Sapiens
MRLLAWLIFLANWGGARAEPGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPDTKVYAALGNHDFHPKNQFPAGSNNIYNQIAELWKPWLSNESIALFKKGAFYCEKLPGPSGAGRIVVLNTNLYYTSNALTADMADPGQQFQWLEDVLTDASKAGDMVYIVGHVPPGFFEKTQNKAWFREGFNEKYLKVVRKHHRVIAGQFFGHHHTDSFRMLYDDAGVPISAMFITPGVTPWKTTLPGVVNGANNPAIRVFEYDRATLSLKVRSPAEARGGGWEGLKCITTFPHSQLIHLPLTTEPQEG

SEQ ID NO: 12605 - protein, 407 aa, Homo Sapiens
MRLLAWLIFLANWGGARAEPGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPGAFYCEKLPGPSGAGRIVVLNTNLYYTSNALTADMADPGQQFQWLEDVLTDASKAGDMVYIVGHVPPGFFEKTQNKAWFREGFNEKYLKVVRKHHRVIAGQFFGHHHTDSFRMLYDDAGVPISAMFITPGVTPWKTTLPGVVNGANNPAIRVFEYDRATLSLKDMVTYFMNLSQANAQGTPRWELEYQLTEAYGVPDASAHSMHTVLDRIAGDQSTLQRYYVYNSVSYSAGVCDEACSMQHVCAMRQVDIDAYTTCLYASGTTPVPQLPLLLMALLGLCTLVL

SEQ ID NO: 12606 - protein, 134 aa, Homo Sapiens
MKSLTWILGLWALAACFTPGESQRGPRGPYPPGPLAPPPPPCFPFGTGFVPPPHPPPYGPGRFPPPLSPPYGPGRIPPSPPPPYGPGRIQSHSLPPPYGPGYPQPPSQPRPYPPGPPFFPVNSPTDPALPTPAP

SEQ ID NO: 12607 - protein, 79 aa, Homo Sapiens
MKSLTWILGLWALAACFTPGESQRGPRGPYPPGPLAPPQPFGPGFVPPPPPPPYGPGRIPPPPPAPYGPGIFPPPPPQP

SEQ ID NO: 12608 - protein, 79 aa, Homo Sapiens; identical to SEQ ID NO: 12607

SEQ ID NO: 12609 - protein, 79 aa, Homo Sapiens; identical to SEQ ID NO: 12607

SEQ ID NO: 12610 - protein, 599 aa, Homo Sapiens
MHGILGACGRLRLEPATPLTPLLCAERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSHVPGNCSENPCQNGGTCVPGADAHSCDCGPGFKGRRCELACIKVSRPCTRLFSETKAFPVWEGGVCHHVYKRVYRVHQDICFKESCESTSLK

SEQ ID NO: 12611 - protein, 1413 aa, Homo Sapiens
MRHGVAWALLVAAALGLGARGVRGAVALADFYPFGAERGDAVTPKQDDGGSGLRPLSVPFPFFGAEHSGLYVNNNGIISFLKEVSQFTPVAFPIAKDRCVVAAFWADVDNRRAGDVYYREATDPAMLRRATEDVRHYFPELLDFNATWVFVATWYRVTFFGGSSSSPVNTFQTVLITDGKLSFTIFNYESIVWTTGTHASSGGNATGLGGIAAQAGFNAGDGQRYFSIPGSRTADMAEVETTTNVGVPGRWAFRIDDAQVRVGGCGHTTSVCLALRPCLNGGKCIDDCVTGNPSYTCSCLSGFTGRRCHLDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYHCSCPYRFTGRHCEIGKPDSCASGPCHNGGTCFHYIGKYKCDCPPGFSGRHCEIAPSPCFRSPCVNGGTCEDRDTDFFCHCQAGYMGRRCQAEVDCGPPEEVKHATLRFNGTRLGAVALYACDRGYSLSAPSRIRVCQPHGVWSEPPQCLEIDECRSQPCLHGGSCQDRVAGYLCLCSTGYEGAHCELERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSQPTASAQLENMEEAPKRVSLALQLPEHGSKDIGNVPGNCSENPCQNGGTCVPGADAHSCDCGPGFKGRRCELACIKVSRPCTRLFSETKAFPVWEGGVCHHVYKRVYRVHQDICFKESCESTSLKKTPNRKQSKSQTLEKS

SEQ ID NO: 12612 - protein, 1324 aa, Homo Sapiens
MRHGVAWALLVAAALGLGARGVRGAVALADFYPFGAERGDAVTPKQDDGGSGLRPLSVPFPFFGAEHSGLYVNNNGIISFLKEVSQFTPVAFPIAKDRCVVAAFWADVDNRRAGDVYYREATDPAMLRRATEDVRHYFPELLDFNATWVFVATWYRVTFFGGSSSSPVNTFQTVLITDGKLSFTIFNYESIVWTTGTHASSGGNATGLGGIAAQAGFNAGDGQRYFSIPGSRTADMAEVETTTNVGVPGRWAFRIDDAQVRVGGCGHTTSVCLALRPCLNGGKCIDDCVTGNPSYTCSCLSGFTGRRCHLDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYHCSCPYRFTGRHCEIGKPDSCASGPCHNGGTCFHYIGKYKCDCPPGFSGRHCEIAPSPCFRSPCVNGGTCEDRDTDFFCHCQAGYMGRRCQAEVDCGPPEEVKHATLRFNGTRLGAVALYACDRGYSLSAPSRIRVCQPHGVWSEPPQCLEIDECRSQPCLHGGSCQDRVAGYLCLCSTGYEGAHCELERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSQPTASAQLENMEEAPKRVSLALQLPEHGSKDIGSESAALVGTLGLTDCSQGP

SEQ ID NO: 12613 - protein, 1352 aa, Homo Sapiens
MRHGVAWALLVAAALGLGARGVRGAVALADFYPFGAERGDAVTPKQDDGGSGLRPLSVPFPFFGAEHSGLYVNNNGIISFLKEVSQFTPVAFPIAKDRCVVAAFWADVDNRRAGDVYYREATDPAMLRRATEDVRHYFPELLDFNATWVFVATWYRVTFFGGSSSSPVNTFQTVLITDGKLSFTIFNYESIVWTTGTHASSGGNATGLGGIAAQAGFNAGDGQRYFSIPGSRTADMAEVETTTNVGVPGRWAFRIDDAQVRVGGCGHTTSVCLALRPCLNGGKCIDDCVTGNPSYTCSCLSGFTGRRCHLDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYHCSCPYRFTGRHCEIGKPDSCASGPCHNGGTCFHYIGKYKCDCPPGFSGRHCEIAPSPCFRSPCVNGGTCEDRDTDFFCHCQAGYMGRRCQAEVDCGPPEEVKHATLRFNGTRLGAVALYACDRGYSLSAPSRIRVCQPHGVWSEPPQCLEIDECRSQPCLHGGSCQDRVAGYLCLCSTGYEGAHCELERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLARTRPRPVEGFEVTNVTASTISVQWALHRIRHATVSGVRVSIRHPEALRDQATDVDRSVDRFTFRALLPGKRYTIQLTTLSGLRGEEHPTESLATAPTHVWTRPLPPANLTAARVTATSAHVVWDAPTPGSLLEAYVINVTTSQSTKSRYVPNGKLASYTVRDLLPGRRYQLSVIAVQSTELGPQHSEPAHLYIITSPRDGADRRWHQGGHHPRVLKNRPPPARLPELRLLNDHSAPETPTQPPRFSELVDGRGRVSARFGGSPSKAATVRSHVPGNCSENPCQNGGTCVPGADAHSCDCGPGFKGRRCELACIKVSRPCTRLFSETKAFPVWEGGVCHHVKQSKSQTLEKS

SEQ ID NO: 12614 - protein, 66 aa, Homo Sapiens
QCQVENGSAVCVCQAGYTGAACEMDVDDCSPDPCLNGGSCVDLVGNYTCLCAEPFKGLRCETVVTC

SEQ ID NO: 12615 - protein, 272 aa, Homo Sapiens
  misc_feature (1)..(1): Xaa can be any naturally occurring amino acid
XPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKGMAGRGVRAGVSTLESARGPPSCFSAVSLLVSRIAD

SEQ ID NO: 12616 - protein, 300 aa, Homo Sapiens
  misc_feature (1)..(1): Xaa can be any naturally occurring amino acid
XSLPHVSDVNECASQPCQNGGTCTHGINSFRCQCPAGFGGPTCETAQSPCDTKECQHGGQCQVENGSAVCVCQAGYTGAACEMDVDDCSPDPCLNGGSCVDLVGNYTCLCAEPFKGLRCETGDHPVPDACLSAPCHNGGTCVDADQGYVCECPEGFMGLDCRERVPDDCECRNGGRCLGANTTLCQCPLGFFGLLCEFEITAMPCNMNTQCPDGGYCMEHGGSYLCVCHTDHNASHSLPSPCDSDPCFNGGSCDAHDDSYTCECPRGFHGKHCEKARPHLCSSGPCRNGGTCKEAGGEYH

SEQ ID NO: 12617 - protein, 28 aa, Homo Sapiens
MAVAAAAAAAGPAGAGGGRAQRSGLLEV

SEQ ID NO: 12618 - protein, 538 aa, Homo Sapiens [sequence omitted]

SEQ ID NO: 12619 - protein, 538 aa, Homo Sapiens [sequence omitted]

SEQ ID NO: 12620 - protein, 540 aa, Homo Sapiens
MRVAAATAAAGAGPAMAVWTRATKAGLVELLLRERWVRVVAELSGESLSLTGDAAAAELEPALGPAAAAFNGLPNGGGAGDSLPGSPSRGLGPPSPPAPPRGPAGEAGASPPVRRVRVVKQEAGGLGISIKGGRENRMPILISKIFPGLAADQSRALRLGDAILSVNGTDLRQATHDQAVQALKRAGKEVLLEVKFIREVTPYIKKPSLVSDLPWEGAAPQSPSFSGSEDSGSPKHQNSTKDRKIIPLKMCFAARNLSMPDLENRLIELHSPDSRNTLILRCKDTATAHSWFVAIHTNIMALLPQVLAELNAMLGATSTAGGSKEVKHIAWLAEQAKLDGGRQQWRPVLMAVTEKDLLLYDCMPWTRDAWASPCHSYPLVATRLVHSGSGCRSPSLGSDLTFATRTGSRQGIEMHLFRVETHRDLSSWTRILVQGCHAAAELIKEVSLGCMLNGQEVRLTIHYENGFTISRENGGSSSILYRYPFERLKMSADDGIRNLYLDFGGPEGELTMDLHSCPKPIVFVLHTFLSAKVTRMGLLV

SEQ ID NO: 12621 - protein, 267 aa, Homo Sapiens
MRVAAATAAAGAGPAMAVWTRATKAGLVELLLRERWVRVVAELSGESLSLTGDAAAAELEPALGPAAAAFNGLPNGGGAGDSLPGSPSRGLGPPSPPAPPRGPAGEAGASPPVRRVRVVKQEAGGLGISIKGGRENRMPILISKIFPGLAADQSRALRLGDAILSVNGTDLRQATHDQAVQALKRAGKEVLLEVKFIREVTPYIKKPSLVSDLPWEGAAPQSPSFSGSEDSGSPKHQNSTKDRKIIPLKMCFAARNLSMPDLENRQN

SEQ ID NO: 12622 - protein, 64 aa, Homo Sapiens
  misc_feature (1)..(1): Xaa can be any naturally occurring amino acid
XGRENRMPILISKIFPGLAADQSRALRLGDAILSVNGTDLRQATHDQAVQALKRAGKEVLLEGL

SEQ ID NO: 12623 - protein, 162 aa, Homo Sapiens
  misc_feature (1)..(1): Xaa can be any naturally occurring amino acid
XGRENRMPILISKIFPGLAADQSRALRLGDAILSVNGTDLRQATHDQAVQALKRAGKEVLLEVKFIREVTPYIKKPSLVSDLPWEGAAPQSPSFSGSEDSGSPKHQNSTKDRKIIPLKMCFAARNLSMPDLENRLIELHSPDSRNTLILRCKDTATAHSWQN

SEQ ID NO: 12624 - protein, 139 aa, Homo Sapiens
  misc_feature (1)..(1): Xaa can be any naturally occurring amino acid
XPHLQDLPRAGCRPEPGAAAGRRHPVGERHRPAPGHPRPGRAGAEARGQGVKFIREVTPYIKKPSLVSDLPWEGAAPQSPSFSGSEDSGSPKHQNSTKDRKIIPLKMCFAARNLSMPDLENRLIELHSPDSRNTLILRC

SEQ ID NO: 12625 - protein, 212 aa, Homo Sapiens
DAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVDAIFCENTEPRSLQDKQKGAKQTFEEMMNYIPDLLVKCIGEETKYESIRL

SEQ ID NO: 12626 - protein, 91 aa, Homo Sapiens
MIFWSFVAGVVTFYCSLGPDSLLPNIFFTIKYKPKQLGLQELFPQGHSCAVCGKVKCKRHRPSLLLENYQPWLDLKISSKVDASLSEGCDR

SEQ ID NO: 12627 - protein, 145 aa, Homo Sapiens
MIFWSFVAGVVTFYCSLGPDSLLPNIFFTIKYKPKQLGLQELFPQGHSCAVCGKVKCKRHRPSLLLENYQPWLDLKISSKVDASLSEVDIPSIITKKLLKAAMKHIEVIVKARQKVKNTEFLQQAALEEYGPELHVALRSRRDEL

SEQ ID NO: 12628 - protein, 894 aa, Homo Sapiens
MIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 12629 - protein, 833 aa, Homo Sapiens
MKMKTFVIIHFHLIQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQ

SEQ ID NO: 12630 - protein, 236 aa, Homo Sapiens
MVPWVRTMGQKLKQRLRLDVGREICRQYPLFCFLLLCLSAASLLLNRYIHILMIFWSFVAGVVTFYCSLGPDSLLPNIFFTIKYKPKLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSR

SEQ ID NO: 12631 - protein, 893 aa, Homo Sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 12632 - protein, 183 aa, Homo Sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHK

SEQ ID NO: 12633 - protein, 946 aa, Homo Sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 12634 - protein, 937 aa, Homo Sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 12635 - protein, 665 aa, Homo Sapiens
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRRKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 12636 - protein, 178 aa, Homo Sapiens
  misc_feature (1)..(1): Xaa can be any naturally occurring amino acid
XKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVTEKQ

SEQ ID NO: 12637 - protein, 54 aa, Homo Sapiens
MLALLCSCLLLAAGASDAWTGEDSAEPNSDSAEWIRDMYAKVTEIWQEVMQRRD

SEQ ID NO: 12638 - protein, 240 aa, Homo Sapiens
MLALLCSCLLLAAGASDAWTGEDSAEPNSDSAEWIRDMYAKVTEIWQEVMQRRDDDGALHAACQVQPSATLDAAQPRVTGVVLFRQLAPRAKLDAFFALEGFPTEPNSSSRAIHVHQFGDLSQGCESTGPHYNPLAVPHPQHPGDFGNFAVRDGSLWRYRAGLAASLAGPHSIVGRAVVVHAGEDDLGRGGNQASVENGNAGRRLACCVVGVCGPGLWERQAREHSERKKRRRESECKAA

SEQ ID NO: 12639 - protein, 213 aa, Homo Sapiens
MQLPLALCLVCLLVHTAFRVVEGQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 12640 - protein, 230 aa, Homo Sapiens
MLPPAIHFYLLPLACILMKSCLAFKNDATEILYSHVVKPVPAHPSSNSTLNQARNGGRHFSNTGLDRNRTESLTRQNYFWLFPGAFLRQLQEARVQVGCRELRSTKYISDGQCTSISPLKELVCAGECLPLPVLPNWIGGGYGTKYWSRRSSQEWRCVNDKTRTQRIQLQCQDGSTRTYKITVVTACKCKRYTRQHNESSHNFESMSPAKPVQHHRERKRASKSSKHSMS

SEQ ID NO: 12641 - protein, 206 aa, Homo Sapiens
MLPPAIHFYLLPLACILMKSCLAFKNDATEILYSHVVKPVPAHPSSNSTLNQARNGGRHFSNTGLDRNTRVQVGCRELRSTKYISDGQCTSISPLKELVCAGECLPLPVLPNWIGGGYGTKYWSRRSSQEWRCVNDKTRTQRIQLQCQDGSTRTYKITVVTACKCKRYTRQHNESSHNFESMSPAKPVQHHRERKRASKSSKHSMS

SEQ ID NO: 12642 - protein, 549 aa, Homo Sapiens
MALAAAAAAAAAGVSQAAVLGFLQEHGGKVRNSELLSRFKPLLDAGDPRGRAARRDRFKQFVNNVAVVKELDGVKFVVLRKKPRPPEPEPAPFGPPGAAAQPSKPTSTVLPRSASAPGAPPLVRVPRPVEPPGDLGLPTEPQDTPGGPASEPAQPPGERSADPPLPALELAQATERPSADAAPPPRAPSEAASPCSDPPDAEPGPGAAKGPPQQKPCMLPVRCVPAPATLRLRAEEPGLRRQLSEEPSPRSSPLLLRRLSVEESGLGLGLGPGRSPHLRRLSRAGPRLLSPDAEELPAAPPPSAVPLEPSEHEWLVRTAGGRWTHQLHGLLLRDRGLAAKRDFMSGFTALHWAAKSGDGEMALQLVEVARRSGAPVDVNARSHGGYTPLHLAALHGHEDAAVLLVVRLGAQVHVRDHSGRRAYQYLRPGSSYALRRLLGDPGLRGTTEPDATGGGSGSLAARRPVQVAATILSSTTSAFLGVLADDLMLQDLARGLKKSSSFSKFLSASPMAPRKKTKIRGGLPAFSEISRRPTPGPLAGLVPSLPPTT

SEQ ID NO: 12643 - protein, 146 aa, Homo Sapiens
MLLALVCLLSCLLPSSEAKLYGRCELARVLHDFGLDGYRGYSLADWVCLAYFTSGFNAAALDYEADGSTNNGIFQINSRRWCSNLTPNVPNVCRMYCSDLLNPNLKDTVICAMKITQEPQGLGYWEAWRHHCQGKDLTEWVDGCDF

SEQ ID NO: 12644 - protein, 112 aa, Homo Sapiens
MVSALRGAPLIRVCLAYFTSGFNAAALDYEADGSTNNGIFQINSRRWCSNLTPNVPNVCRMYCSDLLNPNLKDTVICAMKITQEPQGLGYWEAWRHHCQGKDLTEWVDGCDF

SEQ ID NO: 12645 - protein, 215 aa, Homo Sapiens [sequence omitted]

SEQ ID NO: 12646 - protein, 124 aa, Homo Sapiens
MVLCWLLLLVMALPPGTTGVKDCVFCELTDSMQCPGTYMHCGDDEDCFTGHGVAPGTGPVINKGCLRATSCGLEEPVSYRGVTYSLTTNCCTGRLCNRAPSSQTVGATTSLALGLGMLLPPRLL

SEQ ID NO: 12647 - protein, 159 aa, Homo Sapiens
MKAWGTVVVTLATLMVVTVDAKIYERCELAARLERAGLNGYKGYGVGDWLCMAHYESGFDTAFVDHNPDGSSEYGIFQLNSAWWCDNGITPTKNLCHMDCHDLLNRHILDDIRCAKQIVSSQNGLSAWTSWRLHCSGHDLSEWLKGCDMHVKIDPKIHP

SEQ ID NO: 12648 - protein, 159 aa, Homo Sapiens; identical to SEQ ID NO: 12647

SEQ ID NO: 12649 - protein, 159 aa, Homo Sapiens; identical to SEQ ID NO: 12647

SEQ ID NO: 12650 - protein, 195 aa, Homo Sapiens
MAVSQGDGTLCFVLLLCCWQETELRPRTVIPGSPTEIPFSSKQEDMSELLDEILVQEILDLNKTTPSEMPSTASTLSTPLHAGIDENYQAGGSENYHELLENLQFSPGIEVKISNDEANANANLHGDPSENYRGPQVSPGSEKSVSSKEKNSKNTQYENLSILDQILQNIGRSSGNIFHKEQQRTSAQRRSQGSQ

SEQ ID NO: 12651 - protein, 164 aa, Homo Sapiens
MLWLLPTDRGRSGNGNEPQDEILVQEILDLNKTTPSEMPSTASTLSTPLHAGIDENYQAGGSENYHELLENLQFSPGIEVKISNDEANANANLHGDPSENYRGPQVSPGSEKSVSSKEKNSKNTQYENLSILDQILQNIGRSSGNIFHKEQQRTSAQRRSQGSQ

SEQ ID NO: 12652 - protein, 104 aa, Homo Sapiens
MLWLLPTDRGRSGNGNEPQGSPTEIPFSSKQEDMSELLDEILVQEILDLNKTTPSEMPSTASTLSTPLHAGIDENYQAGGSENYHELLENLQFSPGIEVKISND

SEQ ID NO: 12653 - protein, 112 aa, Homo Sapiens
MTFFTHLWDGDPVSQVAGSPTEIPFSSKQEDMSELLDEILVQEILDLNKTTPSEMPSTASTLSTPLHAGIDENYQAGGSENYHELLENLQFSPGIEVKISNDEANANANLHG

SEQ ID NO: 12654 - protein, 80 aa, Homo Sapiens
MKVFFLFAVLFCLVQTNSGDVPLGIRNTICRMQQGICRLFFCHSGEKKRDISSDPWNRCCVSNTDEEGKEKPEMDGRSGI

SEQ ID NO: 12655 - protein, 50 aa, Homo Sapiens
MKVFFLFAVLFCLVQTNSVHISHQEARGPSFKICVGFLGPRWARGCSTGN

SEQ ID NO: 12656 - protein, 113 aa, Homo Sapiens
MRQRLLPSVTSLLLVALLFPGSSQARHVNHSATEALGELRERAPGQGTNGFQLLRHAVKRDLLPPRTPPYQEPASDLKVVDCRRSEGFCQEYCNYMETQVGYCSKKKDACCLH

SEQ ID NO: 12657 - protein, 133 aa, Homo Sapiens
MRQRLLPSVTSLLLVALLFPGSSQARHVNHSATEALGELRERAPGQGTNGFQLLRHAVKRDLLPPRTPPYQGDVPLGIRNTICRMQQGICRLFFCHSGEKKRDISSDPWNRCCVSNTDEEGKEKPEMDGRSGI

SEQ ID NO: 12658 - protein, 108 aa, Homo Sapiens
MRQRLLPSVTSLLLVALLFPGSSQARHVNHSATEALGELRERAPGQGTNGFQLLRHAVKRDLLPPRTPPYQGDVPLGIRNTICRMQQGICRLFFCHSGTGQQHRQRCG

SEQ ID NO: 12659 - protein, 82 aa, Homo Sapiens
MRQRLLPSVTSLLLVALLFPGSSQARHVNHSATEALGELRERAPGQGTNGFQLLRHAVKRDLLPPRTPPYQGTGQQHRQRCG

SEQ ID NO: 12660 - protein, 103 aa, Homo Sapiens
MRQRLLPSVTSLLLVALLFPGSSQARHVNHSATEALGELRERAPGQGTNGFQLLRHAVKRDLLPPRTPPYQVHISHQEARGPSFKICVGFLGPRWARGCSTGN

SEQ ID NO: 12661 - protein, 53 aa, Homo Sapiens
SSQARHVNHSATEALGELRERAPGQGTNGFQLLRHAVKRDLLPPRTPPYQEMK

SEQ ID NO: 12662 - protein, 106 aa, Homo Sapiens
  misc_feature (1)..(1): Xaa can be any naturally occurring amino acid
XFPGSSQARHVNHSATEALGELRERAPGQGTNGFQLLRHAVKRDLLPPRTPPYQGTHSVAQAGVQWHCYRLLQPLPPGLKCSSHLSLPNTWDHRHAPLHTASFFRC

SEQ ID NO: 12663 - protein, 106 aa, Homo Sapiens
LFPGSSQARHVNHSATEALGELRERAPGQGTNGFQLLRHAVKRDLLPPRTPPYQGTHSVAQAGVQWHCYRLLQPLPPGLKCSSHLSLPNTWDHRHAPLHTASFFRC

SEQ ID NO: 12664 - protein, 80 aa, Homo Sapiens
MKVFFLFAVLFCLVQTNSGDVPPGIRNTICHMQQGICRLFFCHSGEKKRDICSDPWNRCCVSNTDEEGKEKPEMDGRSGI

SEQ ID NO: 12665 - protein, 50 aa, Homo Sapiens
MKVFFLFAVLFCLVQTNSVHISHREARGPSFRICVDFLGPRWARGCSTGN

SEQ ID NO: 12666 - protein, 113 aa, Homo Sapiens; identical to SEQ ID NO: 12656

SEQ ID NO: 12667 - protein, 133 aa, Homo Sapiens
MRQRLLPSVTSLLLVALLFPGSSQARHVNHSATEALGELRERAPGQGTNGFQLLRHAVKRDLLPPRTPPYQGDVPPGIRNTICHMQQGICRLFFCHSGEKKRDICSDPWNRCCVSNTDEEGKEKPEMDGRSGI

SEQ ID NO: 12668 - protein, 108 aa, Homo Sapiens
MRQRLLPSVTSLLLVALLFPGSSQARHVNHSATEALGELRERAPGQGTNGFQLLRHAVKRDLLPPRTPPYQGDVPPGIRNTICHMQQGICRLFFCHSGTGQQHRQRCG

SEQ ID NO: 12669 - protein, 82 aa, Homo Sapiens; identical to SEQ ID NO: 12659

SEQ ID NO: 12670 - protein, 103 aa, Homo Sapiens
MRQRLLPSVTSLLLVALLFPGSSQARHVNHSATEALGELRERAPGQGTNGFQLLRHAVKRDLLPPRTPPYQVHISHREARGPSFRICVDFLGPRWARGCSTGN

SEQ ID NO: 12671 - protein, 53 aa, Homo Sapiens; identical to SEQ ID NO: 12661

SEQ ID NO: 12672 - protein, 115 aa, Homo Sapiens
MCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRL

SEQ ID NO: 12673 - protein, 149 aa, Homo Sapiens
MCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRLEAGDHPVELLARDFEKNYNMYIFPVHWQFGQLDQ

SEQ ID NO: 12674 - protein, 53 aa, Homo Sapiens
MRAWIFFLLCLAGRALAAPQQEALPDETEVVEETVAEVTEVSVGANPVQVEVG

SEQ ID NO: 12675 - protein, 111 aa, Homo Sapiens
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKV

SEQ ID NO: 12676 - protein, 303 aa, Homo Sapiens
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRLEAGDHPVELLARDFEKNYNMYIFPVHWQFGQLDQHPIDGYLSHTELAPLRAPLIPMEHCTTRFFETCDLDNDKYIALDEWAGCFGIKQKDIDKDLVI

SEQ ID NO: 12677 - protein, 56 aa, Homo Sapiens
MKTGLFFLCLLGTAAAIPTNARLLSDHSKPTAETVAPDNTAIPSLRAEAEENEKET

SEQ ID NO: 12678 - protein, 89 aa, Homo Sapiens
MKTGLFFLCLLGTAAAIPTNARLLSDHSKPTAETVAPDNTAIPSLRAEAEENEKETAVSTEDDSHHKAEKSSVLKSKEESHEQSAEQGK

SEQ ID NO: 12679 - protein, 120 aa, Homo Sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTL

SEQ ID NO: 12680 - protein, 127 aa, Homo Sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMS

SEQ ID NO: 12681 - protein, 141 aa, Homo Sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFL

SEQ ID NO: 12682 - protein, 144 aa, Homo Sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPG

SEQ ID NO: 12683 - protein, 664 aa, Homo Sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 12684 - protein, 664 aa, Homo Sapiens; identical to SEQ ID NO: 12683

SEQ ID NO: 12685 - protein, 19 aa, Homo Sapiens
MSEPQEKKLSENTDFLAPG

SEQ ID NO: 12686 - protein, 539 aa, Homo Sapiens
MSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 12687 - protein, 802 aa, Homo Sapiens
MLGARAWLGRVLLLPRAGAGLAASRRCPGVWPRTWPHRSPSRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDKLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 12688 - protein, 56 aa, Homo Sapiens
MLGARAWLGRVLLLPRAGAGLAASRRCPGVWPRTWPHRSPSRPRRLGETNLARSPQ

SEQ ID NO: 12689 - protein, 67 aa, Homo Sapiens
MLGARAWLGRVLLLPRAGAGLAASRRCPGVWPRTWPHRSPSRWALSEGVPMSGFLCLSLTWSSPRPY

SEQ ID NO: 12690 - protein, 786 aa, Homo Sapiens
MLGARAWLGRVLLLPRAGAGLAASRRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDKLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 12691 - protein, 43 aa, Homo Sapiens
MLGARAWLGRVLLLPRAGAGLAASRRSACSPTSRLNSLRSLIP

SEQ ID NO: 12692 - protein, 43 aa, Homo Sapiens; identical to SEQ ID NO: 12691

SEQ ID NO: 12693 - protein, 43 aa, Homo Sapiens; identical to SEQ ID NO: 12691

SEQ ID NO: 12694 - protein, 43 aa, Homo Sapiens; identical to SEQ ID NO: 12691

SEQ ID NO: 12695 - protein, 43 aa, Homo Sapiens; identical to SEQ ID NO: 12691

SEQ ID NO: 12696 - protein, 742 aa, Homo Sapiens
MPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDKLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 12697 - protein, 521 aa, Homo Sapiens
MSHLSSPPKKHKGEHKGHSLPHGSERGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGGAAHLRPSLSA

SEQ ID NO: 12698 - protein, 786 aa, Homo Sapiens
MSHLSSPPKKHKGEHKGHSLPHGSERGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDKLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 12699 - protein, 247 aa, Homo Sapiens
  misc_feature (1)..(1): Xaa can be any naturally occurring amino acid
XESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQTASGTSLTLRRCSMTRHSSLWPIRRPSSSLVMNSTLTWPKASCSTWLGA

SEQ ID NO: 12700 - protein, 110 aa, Homo Sapiens
  misc_feature (1)..(1): Xaa can be any naturally occurring amino acid
XQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQA

SEQ ID NO: 12701 - protein, 350 aa, Homo Sapiens
MKPLVLLVALLLWPSSVPAYPSITVTPDEEQNLNHYIQVLENLVRSVPSGEPGREKKSNSPKHVYSIASKGSKFKELVTHGDASTENDVLTNPISEETTTFPTGGFTPEIGKKKHTESTPFWSIKPNNVSIVLHAEEPYIENEEPEPEPEPAAKQTEAPRMLPVVTESSTSPYVTSYKSPVTTLDKSTGIGISTESEDVPQLSGETAIEKPEEFGKHPESWNNDDILKKILDINSQVQQALLSDTSNPAYREDIEASKDHLKRSLALAAAAEHKLKTMYKSQLLPVGRTSNKIDDIETVINMLCNSRSKLYEYLDIKCVPPEMREKAATVFNTLKNMCRSRRVTALLKVY

SEQ ID NO: 12702 - protein, 65 aa, Homo Sapiens
MKVTGIFLLSALALLSLSGNTGADSLGREAKCYNELNGCTKIYDPVCGTDGNTYPNECVLCFENR

SEQ ID NO: 12703 - protein, 79 aa, Homo Sapiens
MKVTGIFLLSALALLSLSGNTGADSLGREAKCYNELNGCTKIYDPVCGTDGNTYPNECVLCFENRKRQTSILIQKSGPC

SEQ ID NO: 12704 - protein, 94 aa, Homo Sapiens
MAAFPHKIIFFLVCSTLTHVAFSGIFNKRDFTRWPKPRCKMYIPLDPDYNADCPNVTAPVCASNGHTFQNECFFCVEQREFHYRIKFEKYGKCD

SEQ ID NO: 12705 - protein, 94 aa, Homo Sapiens; identical to SEQ ID NO: 12704

SEQ ID NO: 12706 - protein, 54 aa, Homo Sapiens
MYIPLDPDYNADCPNVTAPVCASNGHTFQNECFFCVEQREFHYRIKFEKYGKCD

SEQ ID NO: 12707 - protein, 47 aa, Homo Sapiens
MAKSFPVFSLLSFILIHLVLSSVSGPRHWWPPRGIIKEISWKNQVLP

SEQ ID NO: 12708 - protein, 97 aa, Homo Sapiens
MAKSFPVFSLLSFILIHLVLSSVSGPRHWWPPRGIIKVKCPYEKVNLSWYNGTVNPCPGLYQPICGTNFITYDNPCILCVESLKSHGRIRFYHDGKC

SEQ ID NO: 12709 - protein, 84 aa, Homo Sapiens
MALSVLRLALLLLAVTFAASLIPQFGLFSKYRTPNCSQYRLPGCPRHFNPVCGSDMSTYANECTLCMKIREGGHNIKIIRNGPC

SEQ ID NO: 12710 - protein, 119 aa, Homo Sapiens
MALSVLRLALLLLAVTFAGSARSGPGERGPPEKSGFGSQTGGGPCPAPGGLGDASLIPQFGLFSKYRTPNCSQYRLPGCPRHFNPVCGSDMSTYANECTLCMKIREGGHNIKIIRNGPC

SEQ ID NO: 12711 - protein, 88 aa, Homo Sapiens [sequence omitted]

SEQ ID NO: 12712 - protein, 134 aa, Homo Sapiens
MALSVLRLALLLLAVTFAGSARSGPGERGPPEKSGFGSQTGGGPCPAPGGLGDGTRAPVTGGSPEDLPASLIPQFGLFSKYRTPNCSQYRLPGCPRHFNPVCGSDMSTYANECTLCMKIREGGHNIKIIRNGPC

SEQ ID NO: 12713 - protein, 103 aa, Homo Sapiens [sequence omitted]

SEQ ID NO: 12714 - protein, 134 aa, Homo Sapiens
MALSVLRLALLLLAVTFAGSARSGPGERGPPEKSGFGSQTGGGPCPAPGGLGDGTRAPVTGGSPEDLPGKVVIILKSFEMDPADGAVYRKEDGETTFTGRLDKLHFPFFSFPVFLYMRFVNTHFLRAGMEDSHV

SEQ ID NO: 12715 - protein, 86 aa, Homo Sapiens
MAVRQWVIALALAALLVVDREVPVAAGKLPFSRMPICEHMVESPTCSQMSNLVCGTDGLTYTNECQLCLARIKTKQDIQIMKDGKC

SEQ ID NO: 12716 - protein, 109 aa, Homo Sapiens
MILGIGSSPHLLWTLEGTHIWSLLGDASHTDRLPEAGAGKLLSEVPVAAGKLPFSRMPICEHMVESPTCSQMSNLVCGTDGLTYTNECQLCLARIKTKQDIQIMKDGKC

SEQ ID NO: 12717 - protein, 68 aa, Homo Sapiens
MKIATVSVLLPLALCLIQDAASKNEDQDKKFFQSLDGIMFINKCATCKMILEKEAKSQKRARHLARAP

SEQ ID NO: 12718 - protein, 869 aa, Homo Sapiens
MKIATVSVLLPLALCLIQDAASKNEDQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKQRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGKSRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSI

SEQ ID NO: 12719 - protein, 1064 aa, Homo Sapiens
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKQRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGKSRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKDECSEFRNYIRNNELICPRENDPVHGADGKFYTNKCYMCRAVFLTEALERAKLQEKPSHVRASQEEDSPDSFSSLDSEMCKDYRVLPRIGYLCPKDLKPVCGDDGQTYNNPCMLCHENLIRQTNTHIRSTGKCEESSTPGTTAASMPPSDE

SEQ ID NO: 12720 - protein, 1094 aa, Homo Sapiens
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKQRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGKSRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKDQCRQVQNEAEDAKFRQPGRSLASVARMSTDECSEFRNYIRNNELICPRENDPVHGADGKFYTNKCYMCRAVFLTEALERAKLQEKPSHVRASQEEDSPDSFSSLDSEMCKDYRVLPRIGYLCPKDLKPVCGDDGQTYNNPCMLCHENLIRQTNTHIRSTGKCEESSTPGTTAASMPPSDE

SEQ ID NO: 12721 - protein, 916 aa, Homo Sapiens
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKQRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENDPIQGPDGKVHGNTCSMCEVFFQAEEEEKKKKEGKSRNKRQSKSTASFEELCSEYRKSRKNGRLFCTRENDPIQGPDGKMHGNTCSMCEAFFQQEERARAKAKREAAKEICSEFRDQVRNGTLICTREHNPVRGPDGKMHGNKCAMCASVFKLEEEEKKNDKEEKGKVEAEKVKREAVQELCSEYRHYVRNGRLPCTRENDPIEGLDGKIHGNTCSMCEAFFQQEAKEKERAEPRAKVKREAEKETCDEFRRLLQNGKLFCTRENDPVRGPDGKTHGNKCAMCKAVFQKENEERKRKEEEDQRNAAGHGSSGGGGGNTQDECAEYREQMKNGRLSCTRESDPVRDADGKSYNNQCTMCKAKLEREAERKNEYSRSRSNGTGSESGKDTCDEFRSQMKNGKLICTRESDPVRGPDGKTHGNKCTMCKEKLEREAAEKKKKEDEDRSNTGERSNTGERSNDKEDLCREFRSMQRNGKLICTRENNPVRGPYGKMHINKCAMCQSIFDREANERKKKDEEKSSSKPSNNAKVIY

SEQ ID NO: 12722 - protein, 201 aa, Homo Sapiens
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQFCEPVMVGEGEGRKDLIHVTLVFFQEIGSKLMARTVLCLSSGT

SEQ ID NO: 12723 - protein, 41 aa, Homo Sapiens
MKLSGMFLLLSLALFCFLTGVFSQGGQVDCGEFQDPKVYCT

SEQ ID NO: 12724 - protein, 80 aa, Homo Sapiens
MKLSGMFLLLSLALFCFLTGVFSQGGQVDCGEFQDPKVYCTRESNPHCGSDGQTYGNKCAFCKAIVKSGGKISLKHPGKC

SEQ ID NO: 12725 - protein, 80 aa, Homo Sapiens; identical to SEQ ID NO: 12724

SEQ ID NO: 12726 - protein, 85 aa, Homo Sapiens
MKITGGLLLLCTVVYFCSSSEAASLSPKKVDCSIYKKYPVVAIPCPITYLPVCGSDYITYGNECHLCTESLKSNGRVQFLHDGSC

SEQ ID NO: 12727 - protein, 59 aa, Homo Sapiens
MTQVDCSIYKKYPVVAIPCPITYLPVCGSDYITYGNECHLCTESLKSNGRVQFLHDGSC

SEQ ID NO: 12728 - protein, 97 aa, Homo Sapiens
MKGICSDAILVLATSMWMAFAIDFPLPMASERGQLDKTIVECLKNVNKCWFLSYIKPSEPICGSDQVTYSSDCHLCSKILFEGLNITKLYDGQCENS

SEQ ID NO: 12729 - protein, 86 aa, Homo Sapiens
MRATAIVLLLALTLATMFSIECAKQTKQMVDCSHYKKLPPGQQRFCHHMYDPICGSDGKTYKNDCFFCSKVKKTDGTLKFVHFGKC

SEQ ID NO: 12730 - protein, 107 aa, Homo Sapiens
MVFMNPSHHCFHYKTPPSSSGEHNEPRRLMGLTQPEHLQGIECAKQTKQMVDCSHYKKLPPGQQRFCHHMYDPICGSDGKTYKNDCFFCSKVKKTDGTLKFVHFGKC

SEQ ID NO: 12731 - protein, 294 aa, Homo Sapiens
ELWGLKEGTYLFQLTVTSSDHPEDTANVTVTVLSTKQTEDYCLASNKVGRCRGSFPRWYYDPTEQICKSFVYGGCLGNKNNYLREEECILACRGVQVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTR

SEQ ID NO: 12732 - protein, 529 aa, Homo Sapiens
MAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGGPLRGSSGAQATFPQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 12733 - protein, 513 aa, Homo Sapiens
MAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 12734 - protein, 302 aa, Homo Sapiens
MAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRG

SEQ ID NO: 12735 - protein, 472 aa, Homo Sapiens
PPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGGPLRGSSGAQATFPQVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLV

SEQ ID NO: 12736 - protein, 313 aa, Homo Sapiens
  misc_feature (1)..(1): Xaa can be any naturally occurring amino acid
XEKAAEPQLSEHRVGSRDPSRAGSWDRNLGGPGPTQLTCAGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVELTVTSSDHPEDTANVTVTVLSTKQTEDYCLASNKVGRCRGSFPRWYYDPT

SEQ ID NO: 12737 - protein, 204 aa, Homo Sapiens
  misc_feature (1)..(1): Xaa can be any naturally occurring amino acid
XLGNKNNYLREEECILACRGVQGGPLRGSSGAQATFPQGPSMERRHPDTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRP

SEQ ID NO: 12738 - protein, 240 aa, Homo Sapiens
  misc_feature (1)..(1): Xaa can be any naturally occurring amino acid
XVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGPSMERRHPDTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVV

SEQ ID NO: 12739 - protein, 175 aa, Homo Sapiens [sequence omitted]

SEQ ID NO: 12740 - protein, 252 aa, Homo Sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 12741 - protein, 195 aa, Homo Sapiens
MAQLCGLRRSRAFLALLGSLLLSGVLAADRERSIHENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 12742 - protein, 52 aa, Homo Sapiens
MPRWWYNVTDGSCQLFVYGGCDGNSNNYLTKEECLKKCATVTENATGDLATS

SEQ ID NO: 12743 - protein, 62 aa, Homo Sapiens
MPRWWYNVTDGSCQLFVYGGCDGNSNNYLTKEECLKKCATVTENATGDLATSRNAADSSVPS

SEQ ID NO: 12744 - protein, 202 aa, Homo Sapiens
MPRWWYNVTDGSCQLFVYGGCDGNSNNYLTKEECLKKCATVTENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 12745 - protein, 130 aa, Homo Sapiens
  misc_feature (1)..(1): Xaa can be any naturally occurring amino acid
XPRRQDSEDHSSDMFNYEEYCTANAVTGPCRASFPRWYFDVERNSCNNFIYGGCRGNKNSYRSEEACMLRCFRQQENPPLPLGSKGKWPLTLLLPSACLLPSLTELSPAQLWFTLSFTVNIILAESHVSA

SEQ ID NO: 12746 - protein, 106 aa, Homo Sapiens
  misc_feature (1)..(1): Xaa can be any naturally occurring amino acid
XRGTPAITSSMEAAGAIRTATALRRPACSAASAVCSLPGQQENPPLPLGSKVVVLAGLFVMVLILFLGASMVYLIRVARRNQERALRTVWSSGDDKEQLVKNTYVL

SEQ ID NO: 12747 - protein, 89 aa, Homo Sapiens
MQLQASLSFLLILTLCLELRSELARDTIKDLLPNVCAFPMEKGPCQTYMTRWFFNFETGECELFAYGGCGGNSNNFLRKEKCEKFCKFT

SEQ ID NO: 12748 - protein, 99 aa, Homo Sapiens
MKSAKLGFLLRFFIFCSLNTLLLGGVNKIAEKICGDLKDPCKLDMNFGSCYEVHFRYFYNRTSKRCETFVFSGCNGNLNNFKLKIEREVACVAKYKPPR

SEQ ID NO: 12749 - protein, 377 aa, Homo Sapiens
DDYFRNWNPNKPFDQALDPSKDPCLKVKCSPHKVCVTQDYQTALCVSRKHLLPRQKKGNVAQKHWVGPSNLVKCKPCPVAQSAMVCGSDGHSYTSKCKLEFHACSTGKSLATLCDGPCPCLPEPEPPKHKAERSACTDKELRNLASRLKDWFGALHEDANRVIKPTSSNTAQGRFDTSILPICKDSLGWMFNKLDMNYDLLLDPSEINAIYLDKYEPCIKPLFNSCDSFKDGKLSNNEWCYCFQKPGGLPCQNEMNRIQKLSKGKSLLGAFIPRCNEEGYYKATQCHGSTGQCWCVDKYGNELAGSRKQGAVSCEEEQETSGDFGSGGSVVLLDDLEYERELGPKDKEGKLRVHTRAVTEDDEDEDDDKEDEVGYIW

SEQ ID NO: 12750 - protein, 139 aa, Homo Sapiens
MPAIAVLAAAAAAWCFLQVESRHLDALAGGAGPNHGNFLDNDQWLSTVSQYDRDKYWNRFRDDDYFRNWNPNKPFDQALDPSKDPCLKVKCSPHKVCVTQDYQTALCVSRKHLLPRQKKGNVAQKHWVGPSNLVKCKPC

SEQ ID NO: 12751 - protein, 439 aa, Homo Sapiens
MPAIAVLAAAAAAWCFLQVESRHLDALAGGAGPNHGNFLDNDQWLSTVSQYDRDKYWNRFRDDDYFRNWNPNKPFDQALDPSKDPCLKVKCSPHKVCVTQDYQTALCVSRKHLLPRQKKGNVAQKHWVGPSNLVKCKPCPVAQSAMVCGSDGHSYTSKCKLEFHACSTGKSLATLCDGPCPCLPEPEPPKHKAERSACTDKELRNLASRLKDWFGALHEDANRVIKPTSSNTAQGRFDTSILPICKDSLGWMFNKLDMNYDLLLDPSEINAIYLDKYEPCIKPLFNSCDSFKDGKLSNNEWCYCFQKPGGLPCQNEMNRIQKLSKGKSLLGAFIPRCNEEGYYKATQCHGSTGQCWCVDKYGNELAGSRKQGAVSCEEEQETSGDFGSGGSVVLLDDLEYERELGPKDKEGKLRVHTRAVTEDDEDEDDDKEDEVGYIW

SEQ ID NO: 12752 - protein, 67 aa, Homo Sapiens
MVCGSDGHSYTSKCKLEFHACSTGKSLATLCDGPCPCLPEPEPPKHKAERSACTDKELRNLASRLKD

SEQ ID NO: 12753 - protein, 424 aa, Homo Sapiens
MRAPGCGRLVLPLLLLAAAALAEGDAKGLKEGETPGNFMEDEQWLSSISQYSGKIKHWNRFRDEVEDDYIKSWEDNQQGDEALDTTKDPCQKVKCSRHKVCIAQGYQRAMCISRKKLEHRIKQPTVKLHGNKDSICKPCHMAQLASVCGSDGHTYSSVCKLEQQACLSSKQLAVRCEGPCPCPTEQAATSTADGKPETCTGQDLADLGDRLRDWFQLLHENSKQNGSASSVAGPASGLDKSLGASCKDSIGWMFSKLDTSADLFLDQTELAAINLDKYEVCIRPFFNSCDTYKDGRVSTAEWCFCFWREKPPCLAELERIQIQEAAKKKPGIFIPSCDEDGYYRKMQCDQSSGDCWCVDQLGLELTGTRTHGSPDCDDIVGFSGDFGSGVGWEDEEEKETEEAGEEAEEEEGEAGEADDGGYIW

SEQ ID NO: 12754 - protein, 424 aa, Homo Sapiens; identical to SEQ ID NO: 12753

SEQ ID NO: 12755 - protein, 423 aa, Homo Sapiens [sequence omitted]

SEQ ID NO: 12756 - protein, 77 aa, Homo Sapiens
MRAPGCGRLVLPLLLLAAAALAEGDAKGLKEGETPGNFMEDEQWLSSISQYSGKIKHWNRFRDVPSSDPPSTTQATP

SEQ ID NO: 12757 - protein, 385 aa, Homo Sapiens
MITQDHIHMSSGLSQDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 12758 - protein, 344 aa, Homo Sapiens
MKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 12759 - protein, 316 aa, Homo Sapiens
MKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 12760 - protein, 63 aa, Homo Sapiens
MLKVSAVLCVCAAAWCSQSLAAAAAVAAAGGRSDGGNFLDDKQWLTTISQYDKEVGQWNKFRD

SEQ ID NO: 12761 - protein, 338 aa, Homo Sapiens
MLKVSAVLCVCAAAWCSQSLAAAAAVAAAGGRSDGGNFLDDKQWLTTISQYDKEVGQWNKFRDCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 12762 - protein, 173 aa, Homo Sapiens [sequence omitted]

SEQ ID NO: 12763 - protein, 161 aa, Homo Sapiens
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKL

SEQ ID NO: 12764 - protein, 433 aa, Homo Sapiens
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 12765 - protein, 313 aa, Homo Sapiens
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQGKR

SEQ ID NO: 12766 - protein, 433 aa, Homo Sapiens; identical to SEQ ID NO: 12764

SEQ ID NO: 12767 - protein, 433 aa, Homo Sapiens; identical to SEQ ID NO: 12764

SEQ ID NO: 12768 - protein, 393 aa, Homo Sapiens
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRGFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 12769 - protein, 89 aa, Homo Sapiens
MLKVSAVLCVCAAAWCSQSLAAAAAVAAAGGRSDGGNFLDDKQWLTTISQYDKEVGQWNKFRDDDYFRTWSPGKPFDQALSFHDLGIFV

SEQ ID NO: 12770 - protein, 79 aa, Homo Sapiens
MLKVSAVLCVCAAAWCSQSLAAAAAVAAAGGRSDGGNFLDDKQWLTTISQYDKEVGQWNKFRDDDYFRTWSPGKPFDQG

SEQ ID NO: 12771 - protein, 79 aa, Homo Sapiens; identical to SEQ ID NO: 12770

SEQ ID NO: 12772 - protein, 71 aa, Homo Sapiens
MLKVSAVLCVCAAAWCSQSLAAAAAVAAAGGRSDGGNFLDDKQWLTTISQYDKEVGQWNKFRDDERSRSRP

SEQ ID NO: 12773 - protein, 115 aa, Homo Sapiens
MLKVSAVLCVCAAAWCSQSLAAAAAVAAAGGRSDGGNFLDDKQWLTTISQYDKEVGQWNKFRDEVEDDYFRTWSPGKPFDQALDPAKDPCLKMKCSRHKVCIAQDSQTAVCISHR

SEQ ID NO: 12774 - protein, 115 aa, Homo Sapiens; identical to SEQ ID NO: 12773

SEQ ID NO: 12775 - protein, 436 aa, Homo Sapiens
MLKVSAVLCVCAAAWCSQSLAAAAAVAAAGGRSDGGNFLDDKQWLTTISQYDKEVGQWNKFRDEVEDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 12776 - protein, 436 aa, Homo Sapiens; identical to SEQ ID NO: 12775

SEQ ID NO: 12777 - protein, 436 aa, Homo Sapiens; identical to SEQ ID NO: 12775

SEQ ID NO: 12778 - protein, 436 aa, Homo Sapiens; identical to SEQ ID NO: 12775

SEQ ID NO: 12779 - protein, 122 aa, Homo Sapiens
MLKVSAVLCVCAAAWCSQSLAAAAAVAAAGGRSDGGNFLDDKQWLTTISQYDKEVGQWNKFRDEVEDDYFRTWSPGKPFDQALDPAKDPCLKMKCSRHKVCIAQDSQTAVCISHRRLTHSAN

SEQ ID NO: 12780 - protein, 122 aa, Homo Sapiens; identical to SEQ ID NO: 12779

SEQ ID NO: 12781 - protein, 64 aa, Homo Sapiens
MLKVSAVLCVCAAAWCSQSLAAAAAVAAAGGRSDGGNFLDDKQWLTTISQYDKEVGQWNKFRDL

SEQ ID NO: 12782 - protein, 83 aa, Homo Sapiens
NFLDDKQWLTTISQYDKEVGQWNKFRDDDYFRTWSPGKPFDQALDPAKDPCLKMKCSRHKVCIAQDSQTAVCISHRRLTHSAN

SEQ ID NO: 12783 - protein, 807 aa, Homo Sapiens
MRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCACGTAKYRLTFYGNWSEKTHPKDYPRRANHWSAIIGGSHSKNYVLWEYGGYASEGVKQVAELGSPVKMEEEIRQQSDEVLTVIKAKAQWPAWQPLNVRAAPSAEFSVDRTRHLMSFLTMMGPSPDWNVGLSAEDLCTKECGWVQKVVQDLIPWDAGTDSGVTYESPNKPTIPQEKIRPLTSLDHPQSPFYDPEGGSITQVARVVIERIARKGEQCNIVPDNVDDIVADLAPEEKDEDDTPETCIYSNWSPWSACSSSTCDKGKRMRQRMLKAQLDLSVPCPDTQDFQPCMGPGCSDEDGSTCTMSEWITWSPCSISCGMGMRSRERYVKQFPEDGSVCTLPTEETEKCTVNEECSPSSCLMTEWGEWDECSATCGMGMKKRHRMIKMNPADGSMCKAETSQAEKCMMPECHTIPCLLSPWSEWSDCSVTCGKGMRTRQRMLKSLAELGDCNEDLEQVEKCMLPECPIDCELTEWSQWSECNKSCGKGHVIRTRMIQMEPQFGGAPCPETVQRKKCRIRKCLRNPSIQKLRWREARESRRSEQLKEESEGEQFPGCRMRPWTAWSECTKLCGGGIQERYMTVKKRFKSSQFTSCKDKKEIRACNVHPC

SEQ ID NO: 12784 - protein, 8 aa, Homo Sapiens
MENPSPAA

SEQ ID NO: 12785 - protein, 16 aa, Homo Sapiens
MENPSPAAALGKALCA

SEQ ID NO: 12786 - protein, 17 aa, Homo Sapiens
MENPSPAAALGKALCAL

SEQ ID NO: 12787 - protein, 24 aa, Homo Sapiens
MENPSPAAALGKALCALLLATLGA

SEQ ID NO: 12788 - protein, 61 aa, Homo Sapiens
MENPSPAAALGKALCALLLATLGAAGQPLGGESICSARALAKYSITFTGKWSQTAFPKQYP

SEQ ID NO: 12789 - protein, 64 aa, Homo Sapiens
MENPSPAAALGKALCALLLATLGAAGQPLGGESICSARALAKYSITFTGKWSQTAFPKQYPLFR

SEQ ID NO: 12790 - protein, 108 aa, Homo Sapiens
MENPSPAAALGKALCALLLATLGAAGQPLGGESICSARALAKYSITFTGKWSQTAFPKQYPLFRPPAQWSSLLGAAHSSDYSMWRKNQYVSNGLRDFAERGEAWALMK

SEQ ID NO: 12791 - protein, 331 aa, Homo Sapiens
MENPSPAAALGKALCALLLATLGAAGQPLGGESICSARALAKYSITFTGKWSQTAFPKQYPLFRPPAQWSSLLGAAHSSDYSMWRKNQYVSNGLRDFAERGEAWALMKEIEAAGEALQSVHAVFSAPAVPSGTGQTSAELEVQRRHSLVSFVVRIVPSPDWFVGVDSLDLCDGDRWREQAALDLYPYDAGTDSGFTFSSPNFATIPQDTVTEITSSSPSHPANSFYYPRLKALPPIARVTLVRLRQSPRAFIPPAPVLPSRDNEIVDSASVPETPLDCEVSLWSSWGLCGGHCGRLGTKSRTRYVRVQPANNGSPCPELEEEAECVPDNCV

SEQ ID NO: 12792 - protein, 331 aa, Homo Sapiens; identical to SEQ ID NO: 12791

SEQ ID NO: 12793 - protein, 331 aa, Homo Sapiens; identical to SEQ ID NO: 12791

SEQ ID NO: 12794 - protein, 314 aa, Homo Sapiens
MRIAVICFCLLGITCAIPVKQADSGSSEEKQLYNKYPDAVATWLNPDPSQKQNLLAPQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 12795 - protein, 292 aa, Homo Sapiens
MRIAVICFCLLGITCAIPVKQADSGSSEEKQLYNKYPDAVATWLNPDPSQKQNLLAPQNAVSSEETNDFKQETLPSKSNESHDHMDDMDDEDDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 12796 - protein, 300 aa, Homo Sapiens
MRIAVICFCLLGITCAIPVKQADSGSSEEKQLYNKYPDAVATWLNPDPSQKQNLLAPQTLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 12797 - protein, 287 aa, Homo Sapiens
MRIAVICFCLLGITCAIPVKQADSGSSEEKQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 12798 - protein, 241 aa, Homo Sapiens
MRIAVICFCLLGITCAIPVKQADSGSSEEKQTLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHE

SEQ ID NO: 12799 - protein, 211 aa, Homo Sapiens
MISRMEKMTMMMKILIMFALGMNYWSCSGFPVYDYDPSSLRDALSASVVKVNSQSLSPYLFRAFRSSLKRVEVLDENNLVMNLEFSIRETTCRKDSGEDPATCAFQRDYYVSTAVCRSTVKVSAQQVQGVHARCSWSSSTSESYSSEEMIFGDMLGSHKWRNNYLFGLISDESISEQFYDRSLGIMRRVLPPGNRRYPNHRHRARINTDFE

SEQ ID NO: 12800 - protein, 211 aa, Homo Sapiens; identical to SEQ ID NO: 12799

SEQ ID NO: 12801 - protein, 131 aa, Homo Sapiens
MNLEFSIRETTCRKDSGEDPATCAFQRDYYVSTAVCRSTVKVSAQQVQGVHARCSWSSSTSESYSSEEMIFGDMLGSHKWRNNYLFGLISDESISEQFYDRSLGIMRRVLPPGNRRYPNHRHRARINTDFE

SEQ ID NO: 12802 - protein, 151 aa, Homo Sapiens
MNWAPATCWALLLAAAFLCDSGAAKGGRGGARGSARGGVRGGARGASRVRVRPAQRYGAPGSSLRVAAAGAAAGAAAGAAAGLAAGSGWRRAAGPGERGLEDEEDGVPGGNGTGPGIYSYRAWTSGAGPTRGPRLCLVLGGALGALGLLRP

SEQ ID NO: 12803 - protein, 442 aa, Homo Sapiens
MRRTRRPRFVLMNKMDDLNLHYRFLNWRRRIREIREVRAFRYQERFKHILVDGDTLSYHGNSGEVGCYVASRPLTKDSNYFEVSIVDSGVRGTIAVGLVPQYYSLDHQPGWLPDSVAYHADDGKLYNGRAKGRQFGSKCNSGDRIGCGIEPVSFDVQTAQIFFTKNGKRVGSTIMPMSPDGLFPAVGMHSLGEEVRLHLNAELGREDDSVMMVDSYEDEWGRLHDVRVCGTLLEYLGKGKSIVDVGLAQARHPLSTRSHYFEVEIVDPGEKCYIALGLARKDYPKNRHPGWSRGSVAYHADDGKIFHGSGVGDPFGPRCYKGDIMGCGIMFPRDYILDSEGDSDDSCDTVILSPTARAVRNVRNVMYLHQEGEEEEEEEEEEEDGEEIEPEHEGRKVVVFFTRNGKIIGKKDAVVPSGGFFPTIGMLSCGEKVKVDLHPLSG

SEQ ID NO: 12804 - protein, 165 aa, Homo Sapiens
MRRTRRPRFVLMNKMDDLNLHYRFLNWRRRIREIREVRAFRYQERFKHILVDGDTLSYHGNSGEVGCYVASRPLTKDSNYFEVSIVDSGVRGTIAVGLVPQYYSLDHQPGWLPDSVAYHADDGKWALPSCPCPQMDCSQQWACTPWVRRCGCTSTLSWAVRTTAS

SEQ ID NO: 12805 - protein, 479 aa, Homo Sapiens
MRRTRRPRVLLCQPGWNVVAQSELTAALTCQTQAIFSLLSSWDYRFVLMNKMDDLNLHYRFLNWRRRIREIREVRAFRYQERFKHILVDGDTLSYHGNSGEVGCYVASRPLTKDSNYFEVSIVDSGVRGTIAVGLVPQYYSLDHQPGWLPDSVAYHADDGKLYNGRAKGRQFGSKCNSGDRIGCGIEPVSFDVQTAQIFFTKNGKRVGSTIMPMSPDGLFPAVGMHSLGEEVRLHLNAELGREDDSVMMVDSYEDEWGRLHDVRVCGTLLEYLGKGKSIVDVGLAQARHPLSTRSHYFEVEIVDPGEKCYIALGLARKDYPKNRHPGWSRGSVAYHADDGKIFHGSGVGDPFGPRCYKGDIMGCGIMFPRDYILDSEGDSDDSCDTVILSPTARAVRNVRNVMYLHQEGEEEEEEEEEEEDGEEIEPEHEGRKVVVFFTRNGKIIGKKDAVVPSGGFFPTIGMLSCGEKVKVDLHPLSG

SEQ ID NO: 12806 - protein, 60 aa, Homo Sapiens
  misc_feature (1)..(1): Xaa can be any naturally occurring amino acid
XDGEEIEPEHEGRKVVVFFTRNGKIIGKKDAVVPSGGFFPTIGMLSCGEKVKVDLHPLSG

SEQ ID NO: 12807 - protein, 207 aa, Homo Sapiens
MALLFARSLRLCRWGAKRLGVASTEAQRGVSFKLEEKTAHSSLALFRDDTGVKYGLVGLEPTKVALNVERFREWAVVLADTAVTSGRHYWEVTVKRSQQFRIGVADVDMSRDSCIGVDDRSWVFTYAQRKWYTMLANEKAPVEGIGQPEKVGLLLEYEAQKLSLVDVSQVSVVHTLQTDFRGPVVPAFALWDGELLTHSGLEVPEGL

SEQ ID NO: 12808 - protein, 59 aa, Homo Sapiens
MIVLGWMFFVGLVCYMGTFPELMPPTLKWQERWPVQESKTQLRRRALGEDLLQNHVEGI

SEQ ID NO: 12809 - protein, 59 aa, Homo Sapiens; identical to SEQ ID NO: 12808

SEQ ID NO: 12810 - protein, 56 aa, Homo Sapiens
MIVLGWMFFVGLVCYMGTFPELMPPTLKWQERWPVQESKTQLRRRALGLALPPRLE

SEQ ID NO: 12811 - protein, 76 aa, Homo Sapiens
MIVLGWMFFVGLVCYMGTFPELMPPTLKWQERWPVQESKTQLRRRALGTMWKGYKYPPGGTPVEVSKDDPGEVMQL

SEQ ID NO: 12812 - protein, 40 aa, Homo Sapiens
MIVVLWMLLIAGTMWKGYKYPPGGTPVEVSKDDPGEVMQL

SEQ ID NO: 12813 - protein, 40 aa, Homo Sapiens; identical to SEQ ID NO: 12812

SEQ ID NO: 12814 - protein, 116 aa, Homo Sapiens
MKGLRSLAATTLALFLVFVFLGNSSCAPQRLLERRNWTPQAMLYLKGAQGRRFISDQSRRKDLSDRPLPERRSPNPQLLTIPEAATILLASLQKSPEDEEKNFDQTRFLEDSLLNW

SEQ ID NO: 12815 - protein, 36 aa, Homo Sapiens
MLYLKGAQGRRFISDQSRRKDLSDRPLPDEAQIPNY

SEQ ID NO: 12816 - protein, 158 aa, Homo Sapiens
MMQKLLKCSRLVLALALILVLESSVQGYPTRRARYQWVRCNPDSNSANCLEEKGPMFELLPGESNKIPRLRTDLFPKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 12817 - protein, 431 aa, Homo Sapiens
MLNEDKPSDDYSAVLQRLRKIYHSSIKPLEQSYKYNELRQHEITDGEITSKPMVLFLGPWSVGKSTMINYLLGLENTRYQLYTGAEPTTSEFTVLMHGPKLKTIEGIVMAADSARSFSPLEKFGQNFLEKLIGIEVPHKLLERVTFVDTPGIIENRKQQERGYPFNDVCQWFIDRADLIFVVFDPTKLDVGLELEMLFRQLKGRESQIRIILNKADNLATQMLMRVYGALFWSLAPLINVTEPPRVYVSSFWPQEYKPDTHQELFLQEEISLLEDLNQVIENRLENKIAFIRQHAIRVRIHALLVDRYLQTYKDKMTFFSDGELVFKDIVEDPDKFYIFKTILAKTNVSKFDLPNREAYKDFFGINPISSFKLLSQQCSYMGGCFLEKIERAITQELPGLLGSLGLGKNPGALNCDKTGCSETPKNRYRKH

SEQ ID NO: 12818 - protein, 473 aa, Homo Sapiens
MRALVLLGCLLASLLFSGQAEETEDANEEAPLRDRSHIEKTLMLNEDKPSDDYSAVLQRLRKIYHSSIKPLEQSYKYNELRQHEITDGEITSKPMVLFLGPWSVGKSTMINYLLGLENTRYQLYTGAEPTTSEFTVLMHGPKLKTIEGIVMAADSARSFSPLEKFGQNFLEKLIGIEVPHKLLERVTFVDTPGIIENRKQQERGYPFNDVCQWFIDRADLIFVVFDPTKLDVGLELEMLFRQLKGRESQIRIILNKADNLATQMLMRVYGALFWSLAPLINVTEPPRVYVSSFWPQEYKPDTHQELFLQEEISLLEDLNQVIENRLENKIAFIRQHAIRVRIHALLVDRYLQTYKDKMTFFSDGELVFKDIVEDPDKFYIFKTILAKTNVSKFDLPNREAYKDFFGINPISSFKLLSQQCSYMGGCFLEKIERAITQELPGLLGSLGLGKNPGALNCDKTGCSETPKNRYRKH

SEQ ID NO: 12819 - protein, 486 aa, Homo Sapiens
MRALVLLGCLLASLLFSGQAELQVSASGGTEDVGNLLENHFSAGDASLEEKERALYADTAPQDKKLLLHYPDGREAESPKKTPASAASAGPDPEASLSNASATESPPPGERDDRDAAGPGEEKNGPPVASALPPGGAKGPVEEEWPEPSSGEGQGEEETGFGLPTEGTASGEAGGQAGGHELPEEVQEVQGDSLVQGAVAGTAEPKAEGASPHSEGDGVGPLNAEAEGSPGPGEEPAVPEGAPDVAAVGGESEPDIDTQASEGTEDQGEPGPAAEASAEPGGAQSVKAGDTEENQSPEMTEEDADEASSEEESGDGSGSEEEGGVPSEEESEEDSGDGASSEEAEGASEEATEPQEAGEPQEAREPQEGGDLQEAEESQEGGDPQEAEEPQEGGAPQEGGEPQEGGDPQEAREPQEAREPQEGAELPEATGTTSHRDRGAQPGPEELNTESMGSETLDMKAEEPEEGHQGEGESHHCCPGRDGGCK

SEQ ID NO: 12820 - protein, 56 aa, Homo Sapiens
MAYSNLLRANMDGLKKRDKKNKTKKTKAAAAAAAAAPAAAATAPTTAATTAATAAQ

SEQ ID NO: 12821 - protein, 56 aa, Homo Sapiens; identical to SEQ ID NO: 12820

SEQ ID NO: 12822 - protein, 136 aa, Homo Sapiens
MVLLESEQFLTELTRLFQKCRTSGSVYITLKKYDGRTKPIPKKGTVEGFEPADNKCLLRATDGKKKISTVVSSKEVNKFQMAYSNLLRANMDGLKKRDKKNKTKKTKAAAAAAAAAPAAAATAPTTAATTAATAAQ

SEQ ID NO: 12823 - protein, 115 aa, Homo Sapiens
MVLLESEQFLTELTRLFQKCRTSGSVYITLKKYDGRTKPIPKKGTVEGFEPADNKCLLRATDGKKKISTVVSSKEVNKFQMVSFGCSLCFPSQGKSQYDSEHWVRLILGFTALRR

SEQ ID NO: 12824 - protein, 444 aa, Homo Sapiens
MGSPAHRPALLLLLPPLLLLLLLRVPPSRSFPDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 12825 - protein, 405 aa, Homo Sapiens
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKHMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 12826 - protein, 464 aa, Homo Sapiens
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 12827 - protein, 379 aa, Homo Sapiens
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQAVAANPTLLLQYGASG

SEQ ID NO: 12828 - protein, 62 aa, Homo Sapiens
CAPMKINVNVNSAAGLLDQFYEKQRLLIISAPDPSNRYYKMQISMLQAISAPHSLLLQHGVD

SEQ ID NO: 12829 - protein, 312 aa, Homo Sapiens
MASQLTQRGALFLLFFLTPAVTPTWYAGSGYYPDESYNEVYAEEVPQAPALDYRACLSSIATVPRWCYTLNIQDGEATCYSPKGGNYHSSLGTRCELSCDRGFRLIGRRSVQCLPSRRWSGTAYCRQMRCHALPFITSGTYTCTNGVLLDSRCDYSCSSGYHLEGDRSRICMEDGRWSGGEPVCVDIDPPKIRCPHSREKMAEPEKLTARVYWDPPLVKDSADGTITRVTLRGPEPGSHFPEGEHVIRYTAYDRAYNRASCKFIVKVQVRRCPTLKPPQHGYLTCTSAGDNYGATCEYHCDGGYDRQGTPSR

SEQ ID NO: 12830 - protein, 224 aa, Homo Sapiens
MASQLTQRGALFLLFFLTPAVTPTWYAGSGYYPDESYNEVYAEEVPQAPALDYRVPRWCYTLNIQDGEATCYSPKGGNYHSSLGTRCELSCDRGFRLIGRRSVQCLPSRRWSGTAYCRQMRCHALPFITSGTYTCTNGVLLDSRCDYSCSSGYHLEGDRSRICMEDGRWSGGEPVCVDIDPPKIRCPHSREKMAEPEKLTARVYWDPPLVKDSADGTITRVTLR

SEQ ID NO: 12831 - protein, 465 aa, Homo Sapiens
MASQLTQRGALFLLFFLTPAVTPTWYAGSGYYPDESYNEVYAEEVPQAPALDYRVPRWCYTLNIQDGEATCYSPKGGNYHSSLGTRCELSCDRGFRLIGRRSVQCLPSRRWSGTAYCRQMRCHALPFITSGTYTCTNGVLLDSRCDYSCSSGYHLEGDRSRICMEDGRWSGGEPVCVDIDPPKIRCPHSREKMAEPEKLTARVYWDPPLVKDSADGTITRVTLRGPEPGSHFPEGEHVIRYTAYDRAYNRASCKFIVKVQVRRCPTLKPPQHGYLTCTSAGDNYGATCEYHCDGGYDRQGTPSRVCQSSRQWSGSPPICAPMKINVNVNSAAGLLDQFYEKQRLLIISAPDPSNRYYKMQISMLQQSTCGLDLRHVTIIELVGQPPQEVGRIREQQLSANIIEELRQFQRLTRSYFNMVLIDKQGIDRDRYMEPVTPEEIFTFIDDYLLSNQELTQRREQRDICE

SEQ ID NO: 12832 - protein, 575 aa, Homo Sapiens
MHKEAEMLIGPQLDEKRWGWRLGDGSAAPPFLPQALSFLLLLPLASALQPTPLPFQELRLVGGPSRCRGRLEVMHGGSWGSVCDDDWDVVDANVVCRQLGCGLALPVPRPLAFGQGRGPILLDNVECRGQEAALSECGSRGWGVHNCFHYEDVAVLCDEFLPTQPPTRKMLTSRAPPTTLPNGKSEGSVRLVGGANLCQGRVEILHSGLWGTVCDDDWGLPDAAVVCRQLGCGAAMAATTNAFFGYGTGHILLDNVHCEGGEPRLAACQSLGWGVHNCGHHEDAGALCAGLGPPTLTALPSSATREDWAWQTDPSATGVGPQPSRETALLTTAAWAAGKKSGRLRLVGGPGPCRGRVEVLHAGGWGTVCDDDWDFADARVACREAGCGPALGATGLGHFGYGRGPVLLDNVGCAGTEARLSDCFHLGWGQHNCGHHEDAGALCAGPEELGLQVQQDGSETTRVPTPRPRDGHLRLVNGAHRCEGRVELYLGQRWGTVCDDAWDLRAAGVLCRQLGCGQALAAPGEAHFGPGRGPILLDNVKCRGEESALLLCSHIRWDAHNCDHSEDASVLCQPS

SEQ ID NO: 12833 - protein, 118 aa, Homo Sapiens
DAGAVCDGMPLGYVPPTAPTDSNNSTPREAASRPPSTMTSQAPGTAGVSPPPASPTVLWEPGPEAGPPGLDSISDPFSWSWIPGLGRDRDAWLPGELATKPSASVTASVLEKTTTKAP

SEQ ID NO: 12834 - protein, 90 aa, Homo Sapiens
MRVLACLLAALVGIQAVERLRLADGPHGCAGRLEVWHGGRWGTVCDDGWDLRDAAVACRQLGCGGALAAPGGAFFGEGAGPVWLSELACR

SEQ ID NO: 12835 - protein, 1573 aa, Homo Sapiens
MRVLACLLAALVGIQAVERLRLADGPHGCAGRLEVWHGGRWGTVCDDGWDLRDAAVACRQLGCGGALAAPGGAFFGEGAGPVWLSELACRGNEGQLGLCHHRGWKAHICSHEEDAGVVCAGQRVANSRDDSTSPLDGAPWPGLLLELSPSTEEPLVTHAPRPAGNPQNASRKKSPRPKQAKSTRAPLLTTGAPRQERLRLVSGPHRCAGRLEVWHGGRWGTVCDDGWDLRDAAVACRELGCGGALAAPGGARFGPGAGPVWMDDVGCGGGEQALRDCPRSPWGRSNCDHSEDAGLVCTGPAPRLRLADGPHGCAGRLEVWHGGRWGSVCDDAWDLRDAAVACRELGCGGALAAPGGAFFGEGSGPIILDDLRCRGNETALRFCPARPWGQHDCHHREDAGAVCDGMPLGYVPPTAPTDSNNSTPREAASRPPSTMTSQAPGTAGVSPPPASPTVLWEPGPEAGSPQLRLVAGPSKCSGRLEVWHDQRWGTVCDDSWDMRDSAVVCRELGCGGPQQPDPAAGRFGWGAGPIWLDDVGCVGTEASLSDCPAAPWGKHNCAHNEDVGVTCTGPPGLDSISDPFSWSWIPGLGRDRDAWLPGELATKPSASVTASVLEKTTTKAPGKMPKSTKKWVTKNAKRPTTQPPVMPTTKHSRAQSPPDLTSQTTAALTTEASRRPTSEFTRRPTTEAPQRWTSHTTATLTPQAPRERTTKTMAMLTTQGPQEMTSESTIKSIPQASLEPSAEIPEGSPESPKDPAPSPSVSTTGESGLFRVRLADGPNRCAGRLEVWHAGRWGTVCDDNWDLRDATVACWELGCGKVRPRVGKTHYGPGTGPIWLDDMGCKGSEASLSDCPSGAWGKHNCDHEEDVGLTCTGYTDYDDYPPWTWDPTSREDLAKGTTTAGVPGHTLPWRTTRRPGSSSPAIRRLPDTGSKDGYKLPWTWDTPSGRGLAEGTPTAGKLGPTLGAGTTRSPGSPPTLRVHGDTGSPRKPWPERRPPRPAATRTAPPTPSPGPSASPGPPGPALTSDSSRELTPHSALTSEATSDAPDTSPPTPDPASRTNPDLILTSPDFALSTPDSSVVPALTPEPSPTPLPTLPKELTSDPSTPSEVTSLSPTSEQVPESDTTPDLDTTPYSSTVSEYSRSPDPSPSPHPTTTPDPTMAPDPITTLNPTVTPHFPTTPHPTTTPHPTTITHSTMIPDPTTTPQPFTTITHSTMIPDPTTTPQPFTTMQPTTTPHSTTPHPTTTPHPTTITHSTMIPDPTTTPQPFTTMQPTTMPHPTTTPHPTTTPHPTTTPHPTTTPHPTMTPDPTTTPYPTTTPDPTTTPHPTTPDPSSTPVITTVSLPTSLGTELSSPTLAPTVKPSLHPQLTFTAPAPHTSTSQIPTLEPSPALESSPSRSSTATSMDPLSTEDFKPPRSQSPNLTPPPTHTPHSASDLTVSPDPLLSPTAHPLDHPPLDPLTLGPTPGQSPGPHGPCVAPTPPVRVMACEPPALVELVAAVRDVGGQLQRLTQVVEQERQERQALLLGLTQLVEAARGLGQLGEAVKRLAEMAWTTSMPAPTTTTPEEEERPLRGDV

SEQ ID NO: 12836 - protein, 951 aa, Homo Sapiens
MRVLACLLAALVGIQAVERLRLADGPHGCAGRLEVWHGGRWGTVCDDGWDLRDAAVACRQLGCGGALAAPGGAFFGEGAGPVWLSELACRGNEGQLGLCHHRGWKAHICSHEEDAGVVCAGQRVANSRDDSTSPLDGAPWPGLLLELSPSTEEPLVTHAPRPAGNPQNASRKKSPRPKQAKSTRAPLLTTGAPRQERLRLVSGPHRCAGRLEVWHGGRWGTVCDDGWDLRDAAVACRELGCGGALAAPGGARFGPGAGPVWMDDVGCGGGEQALRDCPRSPWGRSNCDHSEDAGLVCTGPAPRLRLADGPHGCAGRLEVWHGGRWGSVCDDAWDLRDAAVACRELGCGGALAAPGGAFFGEGSGPIILDDLRCRGNETALRFCPARPWGQHDCHHREDAGAVCDGMPLGYVPPTAPTDSNNSTPREAASRPPSTMTSQAPGTAGVSPPPASPTVLWEPGPEAGSPQLRLVAGPSKCSGRLEVWHDQRWGTVCDDSWDMRDSAVVCRELGCGGPQQPDPAAGRFGWGAGPIWLDDVGCVGTEASLSDCPAAPWGKHNCAHNEDVGVTCTGPPGLDSISDPFSWSWIPGLGRDRDAWLPGELATKPSASVTASVLEKTTTKAPGKMPKSTKKWVTKNAKRPTTQPPVMPTTKHSRAQSPPDLTSQTTAALTTEASRRPTSEFTRRPTTEAPQRWTSHTTATLTPQAPRERTTKTMAMLTTQGPQEMTSESTIKSIPQASLEPSAEIPEGSPESPKDPAPSPSVSTTGESGLFRVRLADGPNRCAGRLEVWHAGRWGTVCDDNWDLRDATVACWELGCGKVRPRVGKTHYGPGTGPIWLDDMGCKGSEASLSDCPSGAWGKHNCDHEEDVGLTCTGYTDYDDYPPWTWDPTSREDLAKGTTTAGVPGHTLPWRTTRRPGSSSPAIRRLPDTEPEAGAPRGDAPRSRTARVAAPP

SEQ ID NO: 12837 - protein, 5150 aa, Homo Sapiens
MLLPALLFGMAWALADGRWCEWTETIRVEEEVAPRQEDLVPCASLDHYSRLGWRLDLPWSGRSGLTRSPAPGLCPIYKPPETRPAKWNRTVRTCCPGWGGAHCTEALAKASPEGHCFAMWQCQLQAGSANASAGSLEECCARPWGQSWWDGSSQACRSCSSRHLPGSASSPALLQPLAGAVGQLWSQHQRPSATCASWSGFHYRTFDGRHYHFLGRCTYLLAGAADSTWAVHLTPGDRCPQPGHCQRVTMGPEEVLIQAGNVSVKGQLVPEGQSWLLHGLSLQWLGDWLVLSGGLGVVVRLDRTGSISISVDHELWGQTQGLCGLYNGWPEDDFMEPGGGLAMLAATFGNSWRLPGSESGCLDAVEVAQGCDSPLGLIDADVEPGHLRAEAQDVCHQLLEGPFGQCHAQVSPAEYHEACLFAYCAGAMAGSGQEGRQQAVCATFASYVQACARRHIHIRWRKPGFCERLCPGGQLYSDCVSLCPPSCEAVGQGEEESCREECVSGCECPRGLFWNGTLCVPAAHCPCYYCRQRYVPGDTVRQLCNPCVCRDGRWHCAQALCPAECAVGGDGHYLTFDGRSYSFWGGQGCRYSLVQDYVKGQLLILLEHGACDAGSCLHAISVSLEDTHIQLRDSGAVLVNGQDVGLPWIGAEGLSVRRASSAFLLLRWPGAQVLWGLSDPVAYITLDPRHAHQVQGLCGTFTQNQQDDFLTPAGDVETSIAAFASKFQVAGKGRCPSEDSALLSPCTTHSQRHAFAEAACAILHSSVFQECHRLVDKEPFYLRCLAAVCGCDPGSDCLCPVLSAYARRCAQEGASPPWRNQTLCPVMCPGGQEYRECAPACGQHCGKPEDCGELGSCVAGCNCPLGLLWDPEGQCVPPSLCPCQLGARRYAPGSATMKECNRCICQERGLWNCTARHCPSQAFCPRELVYAPGACLLTCDSPSANHSCPAGSTDGCVCPPGTVLLDERCVPPDLCPCRHSGQWYLPNATIQEDCNVCVCRGRQWHCTGQRRSGRCQASGAPHYVTFDGLAFTYPGACEYLLVREASGLFTVSAQNLPCGASGLTCTKALAVRLEGTVVHMLRGRAVTVNGVSVTPPKVYTGPGLSLRRAGLFLLLSTHLGLTLLWDGGTRVLVQLSPQFRGRVAGLCGDFDGDASNDLRSRQGVLEPTAELAAHSWRLSPLCPEPGDLPHPCTMNTHRAGWARARCGALLQPLFTLCHAEVPPQQHYEWCLYDACGCDSGGDCECLCSAIATYADECARHGHHVRWRSQELCSLQCEGGQVYEACGPTCPPTCHEQHPEPGWHCQVVACVEGCFCPEGTLLHGGACLEPASCPCEWGRNSFPPGSVLQKDCGNCTCQEGQWHCGGDGGHCEELVPACAEGEALCQENGHCVPHGWLCDNQDDCGDGSDEEGCAAPGCGEGQMTCSSGHCLPLALLCDRQDDCGDGTDEPSYPCPQGLLACADGRCLPPALLCDGHPDCLDAADEESCLGQVTCVPGEVSCVDGTCLGAIQLCDGVWDCPDGADEGPGHCPLPSLPTPPASTLPGPSPGSLDTASSPLASASPAPPCGPFEFRCGSGECTPRGWRCDQEEDCADGSDERGCGGPCAPHHAPCARGPHCVSPEQLCDGVRQCPDGSDEGPDACGGLPALGGPNRTGLPCPEYTCPNGTCIGFQLVCDGQPDCGRPGQVGPSPEEQGCGAWGPWSPWGPCSRTCGPWGQGRSRRCSPLGLLVLQNCPGPEHQSQACFTAACPVDGEWSTWSPWSVCSEPCRGTMTRQRQCHSPQNGGRTCAALPGGLHSTRQTKPCPQDGCPNATCSGELMFQPCAPCPLTCDDISGQVTCPPDWPCGSPGCWCPEGQVLGSEGWCVWPRQCPCLVDGARYWPGQRIKADCQLCICQDGRPRRCRLNPDCAVDCGWSSWSPWAKCLGPCGSQSIQWSFRSSNNPRPSGRGRQCRGIHRKARRCQTEPCEGCEHQGQVHRVGERWHGGPCRVCQCLHNLTAHCSPYCPLGSCPQGWVLVEGTGESCCHCALPGENQTVQPMATPAAAPAPSPQIRFPLATYILPPSGDPCYSPLGLAGLAEGSLHASSQQLEHPTQAALLGAPTQGPSPQGWHAGGDAYAKWHTRPHYLQLDLLQPRNLTGILVPETGSSNAYASSFSLQFSSNGLHWHDYRDLLPGILPLPKLFPRNWDDLDPAVWTFGRMVQARFVRVWPHDVHHSDVPLQVELLGCEPGSPPAPLCPGVGLRCASGECVLRGGPCDGVLDCEDGSDEEGCVLLPEGTGRFHSTAKTLALSSAQPGQLLHWPREGLAETEHWPPGQESPTSPTETRPVSPGPASGVPHHGESVQMVTTTPIPQMEARTLPPGMAAVTVVPPHPVTPATPAGQSVAPGPFPPVQCGPGQTPCEVLGCVEQAQVCDGREDCLDGSDERHCARNLLMWLPSLPALWAASTVPFMMPTMALPGLPASRALCSPSQLSCGSGECLSAERRCDLRPDCQDGSDEDGCVDCVLAPWSVWSSCSRSCGLGLTFQRQELLRPPLPGGSCPRDRFRSQSCFVQACPVAGAWAMWEAWGPCSVSCGGGHQSRQRSCVDPPPKNGGAPCPGASQERAPCGLQPCSGGTDCELGRVYVSADLCQKGLVPPCPPSCLDPKANRSCSGHCVEGCRCPPGLLLHDTRCLPLSECPCLVGEELKWPGVSFLLGNCSQCVCEKGELLCQPGGCPLPCGWSAWSSWAPCDRSCGSGVRARFRSPSNPPAAWGGAPCEGDRQELQGCHTVCGTEVFGWTPWTSWSSCSQSCLAPGGGPGWRSRSRLCPSPGDSSCPGDATQEEPCSPPVCPVPSIWGLWAPWSTCSAPCDGGIQTRGRSCSSLAPGDTTCPGPHSQTRDCNTQPCTAQCPENMLFRSAEQCHQEGGPCPRLCLTQGPGIECTGFCAPGCTCPPGLFLHNASCLPRSQCPCQLHGQLYASGAMARLDSCNNCTCVSGKMACTSERCPVACGWSPWTLWSLCSCSCNVGIRRRFRAGTAPPAAFGGAECQGPTMEAEFCSLRPCPGPGGEWGPWSPCSVPCGGGYRNRTRGSSRSLMEFSTCGLQPCAGPVPGMCPRDKQWLDCAQGPASCAELSAPRGTNQTCHPGCHCPSGMLLLNNVCVPTQDCPCAHEGHLYPPGSTVVRPCENCSCVSGLIANCSSWPCAEGEPTWSPWTPWSQCSASCGPARCHRHRFCARSPSAVPSTVAPLPLPATPTPLCSGPEAEEEPCLLQGCDRAGGWGPWGPWSHCSRSCGGGLRSRTRACDQPPPQGLGDYCEGPRAQGEVCQALPCPVTNCTAIEGAEYSPCGPPCPRSCDDLVHCVWRCQPGCYCPPGQVLSSNGAICVQPGHCSCLDLLTGQRHHPGARLARPDGCNHCTCLEGRLNCTDLPCPVPGGWCPWSEWTMCSQPCRGQTRSRSRACACPTPQHGGAPCTGEAGEAGAQHQREACPSYATCPVDGAWGPWGPWSPCDMCLGQSHRSRACSRPPTPEGGRPCPGNHTQSRPCQENSTQCTDCGGGQSLHPCGQPCPRSCQDLSPGSVCQPGSVGCQPTCGCPLGQLSQDGLCVPPAHCRCQYQPGAMGIPENQSRSAGSRFSSWESLEPGEVVTGPCDNCTCVAGILQCQEVPDCPDPGVWSSWGPWEDCSVSCGGGEQLRSRRCARPPCPGPARQSRTCSTQVCREAGCPAGRLYRECQPGEGCPFSCAHVTQQVGCFSEGCEEGCHCPEGTFQHRLACVQECPCVLTAWLLQELGATIGDPGQPLGPGDELDSGQTLRTSCGNCSCAHGKLSCSLDDCFEADGGFGPWSPWGPCSRSCGGLGTRTRSRQCVLTMPTLSGQGCRGPRQDLEYCPSPDCPGAEGSTVEPVTGLPGGWGPWSSWSPCSRSCTDPARPAWRSRTRLCLANCTMGDPLQERPCNLPSCTELPVCPGPGCGAGNCSWTSWAPWEPCSRSCGVGQQRRLRAYRPPGPGGHWCPNILTAYQERRFCNLRACPVPGGWSRWSPWSWCDRSCGGGQSLRSRSCSSPPSKNGGAPCAGERHQARLCNPMPCEAGCPAGMEVVTCANRCPRRCSDLQEGIVCQDDQVCQKGCRCPKGSLEQDGGCVPIGHCDCTDAQGHSWAPGSQHQDACNNCSCQAGQLSCTAQPCPPPTHCAWSHWSAWSPCSHSCGPRGQQSRFRSSTSGSWAPECREEQSQSQPCPQPSCPPLCLQGTRSRTLGDSWLQGECQRCSCTPEGVICEDTECAVPEAWTLWSSWSDCPVSCGGGNQVRTRACRAAAPHHRSPPCLGPDTQTRQQPCPGLLEACSWGPWGPCSRSCGPGLASRSGSCPCLMAKADPTCNSTFLHLDTQGCYSGPCPEECVWSSWSSWTRCSCRVLVQQRYRHQGPASRGARAGAPCTRLDGHFRPCLISNCSEDSCTPPFEFHACGSPCAGLCATHLSHQLCQDLPPCQPGCYCPKGLLEQAGGCIPPEECNCWHTSAAGAGMTLAPGDRLQLGCKECECRRGELHCTSQGCQGLLPLSEWSEWSPCGPCLPPSALAPASRTALEEHWLRDPTGLSPTLAPLLASEQHRHRLCLDPATGRPWTGAPHLCTAPLSQQRLCPDPGACPDSCQWSLWGPWSPCQVPCSGGFRLRWREAEALCGGGCREPWAQESCNGGPCPESCEAQDTVFTLDCANQCPHSCADLWDRVQCLQGPCRPGCRCPPGQLVQDGRCVPISSCRCGLPSANASWELAPAQAVQLDCQNCTCVNESLVCPHQECPVLGPWSAWSSCSAPCGGGTMERHRTCEGGPGVAPCQAQDTEQRQECNLQPCPECPPGQVLSACATSCPCLCWHLQPGAICVQEPCQPGCGCPGGQLLHNGTCVPPTACPCTQHSLPWGLTLTLEEQAQELPPGTVLTRNCTRCVCHGGAFSCSLVDCQVPPGETWQQVAPGELGLCEQTCLEMNATKTQSNCSSARASGCVCQPGHFRSQAGPCVPEDHCECWHLGRPHLPGSEWQEACESCLCLSGRPVCTQHCSPLTCAQGEEMVLEPGSCCPSCRREAPEEQSPSCQLLTELRNFTKGTCYLDQVEVSYCSGYCPSSTHVMPEEPYLQSQCDCCSYRLDPESPVRILNLRCLGGHTEPVVLPVIHSCQCSSCQGGDFSKR

SEQ ID NO: 12838 - protein, 115 aa, Homo Sapiens [sequence omitted]

SEQ ID NO: 12839 - protein, 62 aa, Homo Sapiens
MRLLSFVVLALFAVTQAEEGARLLASKSLLNRYAVEGRDLTLQYNIYNVGSRHVHEEKLRQG

SEQ ID NO: 12840 - protein, 86 aa, Homo Sapiens
MRLLSFVVLALFAVTQAEEGARLLASKSLLNRYAVEGRDLTLQYNIYNVGSRLALPVHLDREESWLSGSLTGDSPLIFWTGQPLGS

SEQ ID NO: 12841 - protein, 147 aa, Homo Sapiens
MRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHF

SEQ ID NO: 12842 - protein, 183 aa, Homo Sapiens
MRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 12843 - protein, 183 aa, Homo Sapiens; identical to SEQ ID NO: 12842

SEQ ID NO: 12844 - protein, 133 aa, Homo Sapiens
MRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVNQPQDSLVLPGS

SEQ ID NO: 12845 - protein, 133 aa, Homo Sapiens; identical to SEQ ID NO: 12844

SEQ ID NO: 12846 - protein, 93 aa, Homo Sapiens
MRLLSFVVLALFAVTQAEEGARLLASKSLLNRYAVEGRDLTLQYNIYNVGSSAALDVELSDDSFPPEDFGIVSGMLNVKWDRIAPWTGQPLGS

SEQ ID NO: 12847 - protein, 90 aa, Homo Sapiens
MRLLSFVVLALFAVTQAEEGARLLASKSLLNRYAVEGRDLTLQYNIYNVGSSAALDVELSDDSFPPEDFGIVSGMLNVKWDRIAPYPLGT

SEQ ID NO: 12848 - protein, 116 aa, Homo Sapiens
MLSCRLQCALAALSIVLALGCVTGAPSDPRLRQFLQKSLAAAAGKQELAKYFLAELLSEPNQTENDALEPEDLSQAAEQDEMRLELQRSANSNPAMAPRERKAGCKNFFWKTFTSC

SEQ ID NO: 12849 - protein, 46 aa, Homo Sapiens
MLEKRSVGCRRCAVVGNSGNLRESSYGPEIDSHDFVLRMNKAPTAG

SEQ ID NO: 12850 - protein, 97 aa, Homo Sapiens
MLEKRSVGCRRCAVVGNSGNLRESSYGPEIDSHDFVLRMNKAPTAGFEADVGTKTTHHLVYPESFRELGDNVSMILVPFKTIDLEWVVSAITTGTIS

SEQ ID NO: 12851 - protein, 47 aa, Homo Sapiens
MVTLRKRTLKVLTFLVLFIFLTSFFLNYSHTMVATTWFPKQMVLELS

SEQ ID NO: 12852 - protein, 49 aa, Homo Sapiens
MVTLRKRTLKVLTFLVLFIFLTSFFLNYSHTMVATTWFPKQMVLELSEN

SEQ ID NO: 12853 - protein, 72 aa, Homo Sapiens
MVTLRKRTLKVLTFLVLFIFLTSFFLNYSHTMVATTWFPKQMVLELSENLKRLIKHRPCTCTHCIGQRKLSA

SEQ ID NO: 12854 - protein, 340 aa, Homo Sapiens
MVTLRKRTLKVLTFLVLFIFLTSFFLNYSHTMVATTWFPKQMVLELSENLKRLIKHRPCTCTHCIGQRKLSAWFDERFNQTMQPLLTAQNALLEDDTYRWWLRLQREKKPNNLNDTIKELFRVVPGNVDPMLEKRSVGCRRCAVVGNSGNLRESSYGPEIDSHDFVLRMNKAPTAGFEADVGTKTTHHLVYPESFRELGDNVSMILVPFKTIDLEWVVSAITTGTISHTYIPVPAKIRVKQDKILIYHPAFIKYVFDNWLQGHGRYPSTGILSVIFSMHVCDEVDLYGFGADSKGNWHHYWENNPSAGAFRKTGVHDADFESNVTATLASINKIRIFKGR

SEQ ID NO: 12855 - protein, 340 aa, Homo Sapiens; identical to SEQ ID NO: 12854

SEQ ID NO: 12856 - protein, 340 aa, Homo Sapiens; identical to SEQ ID NO: 12854

SEQ ID NO: 12857 - protein, 332 aa, Homo Sapiens
MCPAGWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 12858 - protein, 328 aa, Homo Sapiens
MCPAGWKLLAMLALVLVVMVWYSISREDSFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 12859 - protein, 322 aa, Homo Sapiens
MLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 12860 - protein, 153 aa, Homo Sapiens
MRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALA

SEQ ID NO: 12861 - protein, 47 aa, Homo Sapiens
MSVLSGPGWTTGCPWPQNHPNPCHISGREVARGSRDDSSPQESCCLL

SEQ ID NO: 12862 - protein, 339 aa, Homo Sapiens
MVSKSRWKLLAMLALVLVVMVWYSISREDRYIELFYFPIPEKKEPCLQGEAESKASKLFGKLSPLCSYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 12863 - protein, 93 aa, Homo Sapiens
MVSKSRWKLLAMLALVLVVMVWYSISREDRYIELFYFPIPEKKEPCLQGEAESKASKLFGNYSRDQPIFLRLEDYFWVKTPSAYELPYGTKGS

SEQ ID NO: 12864 - protein, 126 aa, Homo Sapiens
MVSKSRWKLLAMLALVLVVMVWYSISREDRYIELFYFPIPEKKEPCLQGEAESKASKLFGNYSRDQPIFLRLEDYFWVKTPSAYELPYGTKGSASGAAAVWSWGTGTGCGTAHWEMPSTSTMWSSD

SEQ ID NO: 12865 - protein, 111 aa, Homo Sapiens
MVSKSRWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKN

SEQ ID NO: 12866 - protein, 209 aa, Homo Sapiens
MVSKSRWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKR

SEQ ID NO: 12867 - protein, 333 aa, Homo Sapiens
MVSKSRWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 12868 - protein, 333 aa, Homo Sapiens; identical to SEQ ID NO: 12867

SEQ ID NO: 12869 - protein, 333 aa, Homo Sapiens; identical to SEQ ID NO: 12867

SEQ ID NO: 12870 - protein, 333 aa, Homo Sapiens; identical to SEQ ID NO: 12867

SEQ ID NO: 12871 - protein, 329 aa, Homo Sapiens
MVSKSRWKLLAMLALVLVVMVWYSISREDSFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 12872 - protein, 329 aa, Homo Sapiens; identical to SEQ ID NO: 12871

SEQ ID NO: 12873 - protein, 178 aa, Homo Sapiens
LIPRLQKIWKNYLSMNKYKVSYKGPGPGIKFSAEALRCHLRDHVNVSMVEVTDFPFNTSEWEGYLPKESIRTKAGPWGRCAVVSSAGSLKSSQLGREIDDHDAVLRFNGAPTANFQQDVGTKTTIRLMNSQISVHHCARAARKVAHFPGYTTHPQESLSCCFLVGYHREALPQRQFVQ

SEQ ID NO: 12874 - protein, 25 aa, Homo Sapiens
MIHTNLKKKFSCCVLVFLLFAVICV

SEQ ID NO: 12875 - protein, 42 aa, Homo Sapiens
MIHTNLKKKFSCCVLVFLLFAVICVWKEKKKGSYYDSFKLQT

SEQ ID NO: 12876 - protein, 45 aa, Homo Sapiens
MIHTNLKKKFSCCVLVFLLFAVICVWKEKKKGSYYDSFKLQTKEF

SEQ ID NO: 12877 - protein, 75 aa, Homo Sapiens
MIHTNLKKKFSCCVLVFLLFAVICVWKEKKKGSYYDSFKLQTKEFQVLKSLGKLAMGSDSQSVSSSSTQDPHRGR

SEQ ID NO: 12878 - protein, 91 aa, Homo Sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEA

SEQ ID NO: 12879 - protein, 97 aa, Homo Sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWN

SEQ ID NO: 12880 - protein, 98 aa, Homo Sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNK

SEQ ID NO: 12881 - protein, 113 aa, Homo Sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIW

SEQ ID NO: 12882 - protein, 127 aa, Homo Sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYK

SEQ ID NO: 12883 - protein, 406 aa, Homo Sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYKGPGPGIKFSAEALRCHLRDHVNVSMVEVTDFPFNTSEWEGYLPKESIRTKAGPWGRCAVVSSAGSLKSSQLGREIDDHDAVLRFNGAPTANFQQDVGTKTTIRLMNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGKATLPGFRTIHC

SEQ ID NO: 12884 - protein, 406 aa, Homo Sapiens; identical to SEQ ID NO: 12883

SEQ ID NO: 12885 - protein, 21 aa, Homo Sapiens
MNSQLVTTEKRFLKDSLYNEG

SEQ ID NO: 12886 - protein, 52 aa, Homo Sapiens
MNSQLVTTEKRFLKDSLYNEGILIVWDPSVYHSDIPKWYQNPDYNFFNNYKT

SEQ ID NO: 12887 - protein, 115 aa, Homo Sapiens
MNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPS

SEQ ID NO: 12888 - protein, 175 aa, Homo Sapiens
MNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGKATLPGFRTIHC

SEQ ID NO: 12889 - protein, 212 aa, Homo Sapiens
LSLLNGSESAKLFAPPRDTPPKCIRCAVVGNGGILNGSRQGPNIDAHDYVFRLNGAVIKGFERDVGTKTSFYGFTVNTMKNSLVSYWNLGFTSVPQGQDLQYIFIPSDIRDYVMLRSAILGVPVPEGLDKGDRFLKSKLINTHFGDLYMPSTGALMLLTALHTCDQVSAYGFITSNYWKFSDHYFERKMKPLIFYANHDLSLEAALWRDLHK

SEQ ID NO: 12890 - protein, 84 aa, Homo Sapiens
MGLPRGSFFWLLLLLTAACSGLLFALYFSAVQRYPGPAAGARARPADTCFTWPFSGTPTSVACSISPFQCCCGGTSSPQRSGTA

SEQ ID NO: 12891 - protein, 374 aa, Homo Sapiens
MGLPRGSFFWLLLLLTAACSGLLFALYFSAVQRYPGPAAGARDTTSFEAFFQSKASNSWTGKGQACRHLLHLAIQRHPHFRGLFNLSIPVLLWGDLFTPALWDRLSQHKAPYGWRGLSHQVIASTLSLLNGSESAKLFAPPRDTPPKCIRCAVVGNGGILNGSRQGPNIDAHDYVFRLNGAVIKGFERDVGTKTSFYGFTVNTMKNSLVSYWNLGFTSVPQGQDLQYIFIPSDIRDYVMLRSAILGVPVPEGLDKGDRPHAYFGPEASASKFKLLHPDFISYLTERFLKSKLINTHFGDLYMPSTGALMLLTALHTCDQVSAYGFITSNYWKFSDHYFERKMKPLIFYANHDLSLEAALWRDLHKAGILQLYQR

SEQ ID NO: 12892 - protein, 74 aa, Homo Sapiens
MGLPRGSFFWLLLLLTAACSGLLFALYFSAVQRYPGPAAGASCQPRVPSTCGCWGEGRGLREAWPPFERGHHII

SEQ ID NO: 12893 - protein, 38 aa, Homo Sapiens
  misc_feature (1)..(1): Xaa can be any naturally occurring amino acid
XDYVMLRSAILGVPVPEGLDKGDSPAPTAQGTAATPAP

SEQ ID NO: 12894 - protein, 336 aa, Homo Sapiens
MKTLMRHGLAVCLALTTMCTSLLLVYSSLGGQKERPPQQQQQQQQQQQQASATGSSQPAAESSTQQRPGVPAGPRPLDGYLGVADHKPLKMHCRDCALVTSSGHLLHSRQGSQIDQTECVIRMNDAPTRGYGRDVGNRTSLRVIAHSSIQRILRNRHDLLNVSQGTVFIFWGPSSYMRRDGKGQVYNNLHLLSQVLPRLKAFMITRHKMLQFDELFKQETGKDRKISNTWLSTGWFTMTIALELCDRINVYGMVPPDFCRDPNHPSVPYHYYEPFGPDECTMYLSHERGRKGSHHRFITEKRVFKNWARTFNIHFFQPDWKPESLAINHPENKPVF

SEQ ID NO: 12895 - protein, 236 aa, Homo Sapiens
MKTLMRHGLAVCLALTTMCTSLLLVYSSLGGQKERPPQQQQQQQQQQQQASATGSSQPAAESSTQQRPGVPAGPRPLDGYLGVADHKPLKMHCRDCALVTSSGHLLHSRQGSQIDQTECVIRMNDAPTRGYGRDVGNRTSLRVIAHSSIQRILRNRHDLLNVSQGTVFIFWGPSSYMRRDGKGQVYNNLHLLSQVLPRLKAFMITRHKMLQFDELFKQETGKDRYPTLGSALAGLQ

SEQ ID NO: 12896 - protein, 333 aa, Homo Sapiens
MACSRPPSQCEPTSLPPGPPAGRRHLPLSRRRREMSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSQRPRLQRMPYHYYEPKGPDECVTYIQNEHSRKGNHHRFITEKRVFSSWAQLYGITFSHPSWT

SEQ ID NO: 12897 - protein, 333 aa, Homo Sapiens; identical to SEQ ID NO: 12896

SEQ ID NO: 12898 - protein, 374 aa, Homo Sapiens
MACSRPPSQCEPTSLPPGPPAGRRHLPLSRRRREMSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSGPASSACPTTTTSPRGRTNVSPTSRMSTVARATTTASSPRKGSSHRGPSCMASPSPTPPGPRPPSLWDLRRVRGEAASAQPLGQGPSSGQSRLAGVSPSQSGP

SEQ ID NO: 12899 - protein, 86 aa, Homo Sapiens
MSSNKEQRSAVFVILFALITILILYSSNSANEVFHYGSLRGRSRRPVNLKKWSITDGYVPILGNKGEVSFVVEHRLVYHGDRGGVV

SEQ ID NO: 12900 - protein, 200 aa, Homo Sapiens
MSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKD

SEQ ID NO: 12901 - protein, 299 aa, Homo Sapiens
MSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSQRPRLQRMPYHYYEPKGPDECVTYIQNEHSRKGNHHRFITEKRVFSSWAQLYGITFSHPSWT

SEQ ID NO: 12902 - protein, 299 aa, Homo Sapiens; identical to SEQ ID NO: 12901

SEQ ID NO: 12903 - protein, 299 aa, Homo Sapiens; identical to SEQ ID NO: 12901

SEQ ID NO: 12904 - protein, 354 aa, Homo Sapiens
MQLQFRSWMLAALTLLVVFLIFADISEIEEEIGAEVVINGSSSPAVVDRSNESIKHNIQPASSKWRHNQTLSLRIRKQILKFLDAEKDISVLKGTLKPGDIIHYIFDRDSTMNVSQNLYELLPRTSPLKNKHFGTCAIVGNSGVLLNSGCGQEIDAHSFVIRCNLAPVQEYARDVGLKTDLVTMNPSVIQRAFEDLVNATWREKLLQRLHSLNGSILWIPAFMARGGKERVEWVNELILKHHVNVRTAYPSLRLLHAVRGYWLTNKVHIKRPTTGLLMYTLATRFCKQIYLYGFWPFPLDQNQNPVKYHYYDSLKYGYTSQASPHTMPLEFKALKSLHEQGALKLTVGQCDGAT

SEQ ID NO: 12905 - protein, 375 aa, Homo Sapiens
MQLQFRSWMLAALTLLVVFLIFADISEIEEEIGNSGGRGTIRSAVNSLHSKSNRAEVVINGSSSPAVVDRSNESIKHNIQPASSKWRHNQTLSLRIRKQILKFLDAEKDISVLKGTLKPGDIIHYIFDRDSTMNVSQNLYELLPRTSPLKNKHFGTCAIVGNSGVLLNSGCGQEIDAHSFVIRCNLAPVQEYARDVGLKTDLVTMNPSVIQRAFEDLVNATWREKLLQRLHSLNGSILWIPAFMARGGKERVEWVNELILKHHVNVRTAYPSLRLLHAVRGYWLTNKVHIKRPTTGLLMYTLATRFCKQIYLYGFWPFPLDQNQNPVKYHYYDSLKYGYTSQASPHTMPLEFKALKSLHEQGALKLTVGQCDGAT

SEQ ID NO: 12906 - protein, 332 aa, Homo Sapiens
MQLQFRSWMLAALTLLVVFLIFADISEIEEEIGNSGGRGTIRSAVNSLHSKSNRKQILKFLDAEKDISVLKGTLKPGDIIHYIFDRDSTMNVSQNLYELLPRTSPLKNKHFGTCAIVGNSGVLLNSGCGQEIDAHSFVIRCNLAPVQEYARDVGLKTDLVTMNPSVIQRAFEDLVNATWREKLLQRLHSLNGSILWIPAFMARGGKERVEWVNELILKHHVNVRTAYPSLRLLHAVRGYWLTNKVHIKRPTTGLLMYTLATRFCKQIYLYGFWPFPLDQNQNPVKYHYYDSLKYGYTSQASPHTMPLEFKALKSLHEQGALKLTVGQCDGAT

SEQ ID NO: 12907 - protein, 46 aa, Homo Sapiens
MRSIRKRWTICTISLLLIFYKTKEIARTEEHQETQLIGASGGGVDS

SEQ ID NO: 12908 - protein, 168 aa, Homo Sapiens
MRSIRKRWTICTISLLLIFYKTKEIARTEEHQETQLIGDGELSLSRSLVNSSDKIIRKAGSSIFQHNVEGWKINSSLVLEIRKNILRFLDAERDVSVVKSSFKPGDVIHYVLDRRRTLNISHDLHSLLPEVSPMKNRRFKTCAVVGNSGILLDSECGKEIDSHNFVIR

SEQ ID NO: 12909 - protein, 359 aa, Homo Sapiens
MRSIRKRWTICTISLLLIFYKTKEIARTEEHQETQLIGDGELSLSRSLVNSSDKIIRKAGSSIFQHNVEGWKINSSLVLEIRKNILRFLDAERDVSVVKSSFKPGDVIHYVLDRRRTLNISHDLHSLLPEVSPMKNRRFKTCAVVGNSGILLDSECGKEIDSHNFVIRCNLAPVVEFAADVGTKSDFITMNPSVVQRAFGGFRNESDREKFVHRLSMLNDSVLWIPAFMVKGGEKHVEWVNALILKNKLKVRTAYPSLRLIHAVRGYWLTNKVPIKRPSTGLLMYTLATRFCDEIHLYGFWPFPKDLNGKAVKYHYYDDLKYRYFSNASPHRMPLEFKTLNVLHNRGALKLTTGKCVKQ

SEQ ID NO: 12910 - protein, 398 aa, Homo Sapiens
MRPGGALLALLASLLLLLLLRLLWCPADAPGRARILVEESREATHGTPAALRTLRSPATAVPRATNSTYLNEKSLQLTEKCKNLQYGIESFSNKTKGYSENDYLQIITDIQSCPWKRQAEEYANFRAKLASCCDAVQNFVVSQNNTPVGTNMSYEVESKKEIPIKKNIFHMFPVSQPFVDYPYNQCAVVGNGGILNKSLCGTEIDKSDFVFRCNLPPTTGDVSKDVGSKTNLVTINPSIITLKYGNLKEKKALFLEDIATYGDAFFLLPAFSFRANTGTSFKVYYTLEESKARQKVLFFHPKYLKDLALFWRTKGVTAYRLSTGLMITSVAVELCKNVKLYGFWPFSKTVEDIPVSHHYYDNKLPKHGFHQMPKEYSQILQLHMKGILKLQFSKCEVA

SEQ ID NO: 12911 - protein, 128 aa, Homo Sapiens
  misc_feature (1)..(1): Xaa can be any naturally occurring amino acid
XYPYNQCAVVGNGGILNKSLCGTEIDKSDFVFRCNLPPTTGDVSKDVGSKTNLVTINPSIITLKYGNLKEKKALFLEDIATYGDAFFLLPAFSFRANTGTSFKVYYTLEESKARQKCKTKRKTINSIL

SEQ ID NO: 12912 - protein, 147 aa, Homo Sapiens
MKRLEEMSNMFQSSGVQHHPPEPKAQTEGNEDSEGKEQRWEMVMDKKHFKLWRRPITGTHLYQYRVFGTYTDVTPRQFFNVQLDTEYRKKWDALVIKLEVIERDVVSGSEVLHWVTHFPYPMYSRDYVYVRRYSVDQENNMMVLVSR

SEQ ID NO: 12913 - protein, 370 aa, Homo Sapiens
MLPRRLLAAWLAGTRGGGLLALLANQCRFVTGLRVRRAQQIAQLYGRLYSESSRRVLLGRLWRRLHGRPGHASALMAALAGVFVWDEERIQEEELQRSINEMKRLEEMSNMFQSSGVQHHPPEPKAQTEGNEDSEGKEQRWEMVMDKKHFKLWRRPITGTHLYQYRVFGTYTDVTPRQFFNVQLDTEYRKKWDALVIKLEVIERDVVSGSEVLHWVTHFPYPMYSRDYVYVRRYSVDQENNMMVLVSRAVEHPSVPESPEFVRVRSYESQMVIRPHKSFDENGFDYLLTYSDNPQTVFPRYCVSWMVSSGMPDFLEKLHMATLKAKNMEIKVKDYISAKPLEMSSEAKATSQSSERKNEGSCGPARIEYA

SEQ ID NO: 12914 - protein, 62 aa, Homo Sapiens
MKFLVFAFILALMVSMIGADSSEEKFLRRIGRFGYGYGPYQPVPEQPLYPQPYQPQYQQYTF

SEQ ID NO: 12915 - protein, 62 aa, Homo Sapiens; identical to SEQ ID NO: 12914

SEQ ID NO: 12916 - protein, 52 aa, Homo Sapiens
MKFLVFAFILALMVSMIGADSSEEYGYGPYQPVPEQPLYPQPYQPQYQQYTF

SEQ ID NO: 12917 - protein, 247 aa, Homo Sapiens
MLQNSAVLLVLVISASATHEAEQNDSVSPRKSRVAAQNSAEVVRCLNSALQVGCGAFACLENSTCDTDGMYDICKSFLYSAAKFDTQGKAFVKESLKCIANGVTSKVFLAIRRCSTFQRMIAEVQEECYSKLNVCSIAKRNPEAITEVVQLPNHFSNRYYNRLVRSLLECDEDTVSTIRDSLMEKIGPNMASLFHILQTDHCAQTHPRADFNRRRTNEPQKLKVLLRNLRGEEDSPSHIKRTSHESA

SEQ ID NO: 12918 - protein, 178 aa, Homo Sapiens
MYDICKSFLYSAAKFDTQGKAFVKESLKCIANGVTSKVFLAIRRCSTFQRMIAEVQEECYSKLNVCSIAKRNPEAITEVVQLPNHFSNRYYNRLVRSLLECDEDTVSTIRDSLMEKIGPNMASLFHILQTDHCAQTHPRADFNRRRTNEPQKLKVLLRNLRGEEDSPSHIKRTSHESA

SEQ ID NO: 12919 - protein, 302 aa, Homo Sapiens
MCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHEPYVDLVNLLLTCGEEVKEAITHSVQVQCEQNWGSLCSILSFCTSAIQKPPTAPPERQPQVDRTKLSRAHHGEAGHHLPEPSSRETGRGAKGERGSKSHPNAHARGRVGGLGAQGPSGSSEWEDEQSEYSDIRR

SEQ ID NO: 12920 - protein, 53 aa, Homo Sapiens
MTFLHNAGKFDAQGKSFIKDALKCKAHALRHRFGCISRKCPAIREMVSQLQRE

SEQ ID NO: 12921 - protein, 123 aa, Homo Sapiens
  misc_feature (1)..(1): Xaa can be any naturally occurring amino acid
XQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHE

SEQ ID NO: 12922 - protein, 276 aa, Homo Sapiens
MGCGPSQPAEDRRRVRAPKKGWKEEFKADVSVPHTGENCSPRMEAALTKNTVDIAEGLEQVQMGSLPGTISENSPSPSERNRRVNSDLVTNGLINKPQSLESRERQKSSDILEELIVQGIIQSHSKVFRNGESYDVTLTTTEKPLRKPPSRLKKLKIKKQVKDFTMKDIEEKMEAAEERRKTKEEEIRKRLRSDRLLPSANHSDSAELDGAEVAFAKGLQRVRSAGFEPSDLQGGKPLKRKKSKCDATLIDRNESDESFGVVESDMSYNQADDIVY

SEQ ID NO: 12923 - protein, 200 aa, Homo Sapiens
MHVFFVFLSLLETLRRLPVADVSVPHTGENCSPRMEAALTKNTVDIAEGLEQVQMGSLPGTISENSPSPSERNRRVNSDLVTNGLINKPQSLESRERQKSSDILEELIVQGIIQSHSKVFRNGESYDVTLTTTEKPLRKPPSRLKKLKIKKQVKDFTMKDIEEKMEAAEERRKTKEEEIRKRLRSDRLLPSANHSDSAEL

SEQ ID NO: 12924 - protein, 45 aa, Homo Sapiens
MLQFLLGFTLGNVVGMYLAQNYDGIGSPSVSQAGVQWWDLGSLQL

SEQ ID NO: 12925 - protein, 47 aa, Homo Sapiens
MLQFLLGFTLGNVVGMYLAQNYDIPNLAKKLEEIKKDLDAKKKPPSA

SEQ ID NO: 12926 - protein, 310 aa, Homo Sapiens
MLARAARGTGALLLRGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSKLAKDSNTILLPSNPGDVTSMVAQAMGVYGALTKAPVPGTPDSLSSGSSRDVQGTDASLDEELDRVKMS

SEQ ID NO: 12927 - protein, 356 aa, Homo Sapiens
MLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSKLAKDSNTILLPSNPGDVTSMVAQAMGVYGALTKAPVPGTPDSLSSGSSRDVQGTDASLDEELDRVKMS

SEQ ID NO: 12928 - protein, 311 aa, Homo Sapiens
MLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRVEAERRKRATVLESEGTRESAINVAEGKKQAQILASEAEKAEQINQAAGEASAVLAKAKAKAEAIRILAAALTQHNGDAAASLTVAEQYVSAFSKLAKDSNTILLPSNPGDVTSMVAQAMGVYGALTKAPVPGTPDSLSSGSSRDVQGTDASLDEELDRVKMS

SEQ ID NO: 12929 - protein, 101 aa, Homo Sapiens
MQMQVEAERRKRATVLESEGTRESAINVAEGKKQAQILASEAEKAEQINQAAGEASAVLAKAKAKAEAIRILAAALTQHVRGPWVGMGTGIDSGRGSLIYA

SEQ ID NO: 12930 - protein, 169 aa, Homo Sapiens
MARPVQLAPGSLALVLCRLEAQKAAGAAEEPGGRAVFRAFRRANARCFWNARLARAASRLAFQGWLRRGVLLVRAPPACLQVLRDAWRRRALRPPRGFRIRAVGDVFPVQMNPITQSQFVPLGEVLCCAISDMNTAQIVVTQESLLERLMKHYPGHRVWDLIIQSFWMD

SEQ ID NO: 12931 - protein, 227 aa, Homo Sapiens
MARPVQLAPGSLALVLCRLEAQKAAGAAEEPGGRAVFRAFRRANARCFWNARLARAASRLAFQGWLRRGVLLVRAPPACLQVLRDAWRRRALRPPRGFRIRAVGDVFPVQMNPITQSQFVPLGEVLCCAISDMNTAQIVVTQESLLERLMKHYPGIAIPSEDILYTTLGTLIKERKIYHTGEGYFIVTPQTYFITNTTTQENKRMLPSDESRLMPASMTYLDTESGI

SEQ ID NO: 12932 - protein, 989 aa, Homo Sapiens
MARPVQLAPGSLALVLCRLEAQKAAGAAEEPGGRAVFRAFRRANARCFWNARLARAASRLAFQGWLRRGVLLVRAPPACLQVLRDAWRRRALRPPRGFRIRAVGDVFPVQMNPITQSQFVPLGEVLCCAISDMNTAQIVVTQESLLERLMKHYPGIAIPSEDILYTTLGTLIKERKIYHTGEGYFIVTPQTYFITNTTTQENKRMLPSDESRLMPASMTYLVSMESCAESAQENAAPISHCQSCQCFRDMHTQDVQEAPVAAEVTRKSHRGLGESVSWVQNGAVSVSAEHHICESTKPLPYTRDKEKGKKFGFSLLWRSLSRKEKPKTEHSSFSAQFPPEEWPVRDEDDLDNIPRDVEHEIIKRINPILTVDNLIKHTVLMQKYEEQKKYNSQGTSTDMLTIGHKYPSKEGVKKRQGLSAKPQGQGHSRRDRHKARNQGSEFQPGSIRLEKHPKLPATQPIPRIKSPNEMVGQKPLGEITTVLGSHLIYKKRISNPFQGLSHRGSTISKGHKIQKTSDLKPSQTGPKEKPFQKPRSLDSSRIFDGKAKEPYAEQPNDKMEAESIYINDPTVKPINDDFRGHLFSHPQQSMLQNDGKCCPFMESMLRYEVYGGENEVIPEVLRKSHSHFDKLGETKQTPHSLPSRGASFSDRTPSACRLVDNTIHQFQNLGLLDYPVGVNPLRQAARQDKDSEELLRKGFVQDAETTSLENEQLSNDDQALYQNEVEDDDGACSSLYLEEDDISENDDLRQMLPGHSQYSFTGGSQGNHLGKQKVIERSLTEYNSTMERVESQVLKRNECYKPTGLHATPGESQEPNLSAESCGLNSGAQFGFNYEEEPSVAKCVQASAPADERIFDYYSARKASFEAEVIQDTIGDTGKKPASWSQSPQNQEMRKHFPQKFQLFNTSHMPVLAQDVQYEHSHLEGTENHSMAGDSGIDSPRTQSLGSNNSVILDGLKRRQNFLQNVEGTKSSQPLTSNSLLPLTPVINV

SEQ ID NO: 12933 - protein, 989 aa, Homo Sapiens; identical to SEQ ID NO: 12932

SEQ ID NO: 12934 - protein, 1101 aa, Homo Sapiens
MARPVQLAPGSLALVLCRLEAQKAAGAAEEPGGRAVFRAFRRANARCFWNARLARAASRLAFQGWLRRGVLLVRAPPACLQVLRDAWRRRALRPPRGFRIRAVGECGTRRGGASRPVQLAPGSLALVLCRLEAQKAAGAAEEPGGRAVFRAFRRANARCFWNARLARAASRLAFQGWLRRGVLLVRAPPACLQVLRDAWRRRALRPPRGFRIRAVGDVFPVQMNPITQSQFVPLGEVLCCAISDMNTAQIVVTQESLLERLMKHYPGIAIPSEDILYTTLGTLIKERKIYHTGEGYFIVTPQTYFITNTTTQENKRMLPSDESRLMPASMTYLVSMESCAESAQENAAPISHCQSCQCFRDMHTQDVQEAPVAAEVTRKSHRGLGESVSWVQNGAVSVSAEHHICESTKPLPYTRDKEKGKKFGFSLLWRSLSRKEKPKTEHSSFSAQFPPEEWPVRDEDDLDNIPRDVEHEIIKRINPILTVDNLIKHTVLMQKYEEQKKYNSQGTSTDMLTIGHKYPSKEGVKKRQGLSAKPQGQGHSRRDRHKARNQGSEFQPGSIRLEKHPKLPATQPIPRIKSPNEMVGQKPLGEITTVLGSHLIYKKRISNPFQGLSHRGSTISKGHKIQKTSDLKPSQTGPKEKPFQKPRSLDSSRIFDGKAKEPYAEQPNDKMEAESIYINDPTVKPINDDFRGHLFSHPQQSMLQNDGKCCPFMESMLRYEVYGGENEVIPEVLRKSHSHFDKLGETKQTPHSLPSRGASFSDRTPSACRLVDNTIHQFQNLGLLDYPVGVNPLRQAARQDKDSEELLRKGFVQDAETTSLENEQLSNDDQALYQNEVEDDDGACSSLYLEEDDISENDDLRQMLPGHSQYSFTGGSQGNHLGKQKVIERSLTEYNSTMERVESQVLKRNECYKPTGLHATPGESQEPNLSAESCGLNSGAQFGFNYEEEPSVAKCVQASAPADERIFDYYSARKASFEAEVIQDTIGDTGKKPASWSQSPQNQEMRKHFPQKFQLFNTSHMPVLAQDVQYEHSHLEGTENHSMAGDSGIDSPRTQSLGSNNSVILDGLKRRQNFLQNVEGTKSSQPLTSNSLLPLTPVINV

SEQ ID NO: 12935 - protein, 969 aa, Homo Sapiens
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEALCENHLGPAPPYSISNFSIHLLCQHTKPATPQPHPSTTAICQTAVWYAVSWAPGAQGWLQACHDQFPDEFLDAICSNLSFSALSGSNRRLVKRLCAGLLPPPTSCPEGLPPVPLTPDIFWGCFLENETLWAERLCGEASLQAVPPSNQAWVQHVCQGPTPDVTASPPCHIGPCGERCPDGGSFLVMVCANDTMYEVLVPFWPWLAGQCRISRGGNDTCFLEGLLGPLLPSLPPLGPSPLCLTPGPFLLGMLSQLPRCQSSVPALAHPTRLHYLLRLLTFLLGPGAGGAEAQGMLGRALLLSSLPDNCSFWDAFRPEGRRSVLRTIGEYLEQDEEQPTPSGFEPTVNPSSGISKMELLACFSPVLWDLLQREKSVWALQILVQAYLHMPPENLQQLVLSAEREAAQGFLTLMLQGKLQGKLQVPPSEEQALGRLTALLLQRYPRLTSQLFIDLSPLIPFLAVSDLMRFPPSLLANDSVQQGYRGSEENSLEEDKGLRPMTPRSLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRWHMNFWVCCAHLEERC

SEQ ID NO: 12936 - protein, 351 aa, Homo Sapiens
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEAL

SEQ ID NO: 12937 - protein, 1775 aa, Homo Sapiens
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEALCENHLGPAPPYSISNFSIHLLCQHTKPATPQPHPSTTAICQTAVWYAVSWAPGAQGWLQACHDQFPDEFLDAICSNLSFSALSGSNRRLVKRLCAGLLPPPTSCPEGLPPVPLTPDIFWGCFLENETLWAERLCGEASLQAVPPSNQAWVQHVCQGPTPDVTASPPCHIGPCGERCPDGGSFLVMVCANDTMYEVLVPFWPWLAGQCRISRGGNDTCFLEGLLGPLLPSLPPLGPSPLCLTPGPFLLGMLSQLPRCQSSVPALAHPTRLHYLLRLLTFLLGPGAGGAEAQGMLGRALLLSSLPDNCSFWDAFRPEGRRSVLRTIGEYLEQDEEQPTPSGFEPTVNPSSGISKMELLACFSPVLWDLLQREKSVWALQILVQAYLHMPPENLQQLVLSAEREAAQGFLTLMLQGKLQGKLQVPPSEEQALGRLTALLLQRYPRLTSQLFIDLSPLIPFLAVSDLMRFPPSLLANDSVLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRLGPLACFLSPEELQSLVPLSDPTGPVERGLLECAANGTLSPEGRVAYELLGVLRSSGGAVLSPRELRVWAPLFSQLGLRFLQELSEPQLRAMLPVLQGTSVTPAQAVLLLGRLLPRHDLSLEELCSLHLLLPGLSPQTLQAIPRRVLVGACSCLAPELSRLSACQTAALLQTFRVKDGVKNMGTTGAGPAVCIPGQPIPTTWPDCLLPLLPLKLLQLDSLALLANRRRYWELPWSEQQAQFLWKKMQVPTNLTLRNLQALGTLAGGMSCEFLQQINSMVDFLEVVHMIYQLPTRVRGSLRACIWAELQRRMAMPEPEWTTVGPELNGLDSKLLLDLPIQLMDRLSNESIMLVVELVQRAPEQLLALTPLHQAALAERALQNLAPKETPVSGEVLETLGPLVGFLGTESTRQIPLQILLSHLSQLQGFCLGETFATELGWLLLQESVLGKPELWSQDEVEQAGRLVFTLSTEAISLIPREALGPETLERLLEKQQSWEQSRVGQLCREPQLAAKKAALVAGVVRPAAEDLPEPVPNCADVRGTFPAAWSATQIAEMELSDFEDCLTLFAGDPGLGPEELRAAMGKAKQLWGPPRGFRPEQILQLGRLLIGLGDRELQELILVDWGVLSTLGQIDGWSTTQLRIVVSSFLRQSGRHVSHLDFVHLTALGYTLCGLRPEELQHISSWEFSQAALFLGTLHLQCSEEQLEVLAHLLVLPGGFGPISNWGPEIFTEIGTIAAGIPDLALSALLRGQIQGVTPLAISVIPPPKFAVVFSPIQLSSLTSAQAVAVTPEQMAFLSPEQRRAVAWAQHEGKESPEQQGRSTAWGLQDWSRPSWSLVLTISFLGHLL

SEQ ID NO: 12938 - protein, 1002 aa, Homo Sapiens
MELLACFSPVLWDLLQREKSVWALQILVQAYLHMPPENLQQLVLSAEREAAQGFLTLMLQGKLQGKLQVPPSEEQALGRLTALLLQRYPRLTSQLFIDLSPLIPFLAVSDLMRFPPSLLANDSVQQGYRGSEENSLEEDKGLRPMTPRSLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRLGPLACFLSPEELQSLVPLSDPTGPVERGLLECAANGTLSPEGRVAYELLGVLRSSGGAVLSPRELRVWAPLFSQLGLRFLQELSEPQLRAMLPVLQGTSVTPAQAVLLLGRLLPRHDLLQLDSLALLANRRRYWELPWSEQQAQFLWKKMQVPTNLTLRNLQALGTLAGGMSCEFLQQINSMVDFLEVVHMIYQLPTRVRGSLRACIWAELQRRMAMPEPEWTTVGPELNGLDSKLLLDLPIQLMDRLSNESIMLVVELVQRAPEQLLALTPLHQAALAERALQNLAPKETPVSGEVLETLGPLVGFLGTESTRQIPLQILLSHLSQLQGFCLGETFATELGWLLLQESVLGKPELWSQDEVEQAGRLVFTLSTEAISLIPREALGPETLERLLEKQQSWEQSRVGQLCREPQLAAKKAALVAGVVRPAAEDLPEPVPNCADVRGTFPAAWSATQIAEMELSDFEDCLTLFAGDPGLGPEELRAAMGKAKQLWGPPRGFRPEQILQLGRLLIGLGDRELQELILVDWGVLSTLGQIDGWSTTQLRIVVSSFLRQSGRHVSHLDFVHLTALGYTLCGLRPEELQHISSWEFSQAALFLGTLHLQCSEEQLEVLAHLLVLPGGFGPISNWGPEIFTEIGTIAAGIPDLALSALLRGQIQGVTPLAISVIPPPKFAVVFSPIQLSSLTSAQAVAVTPEQMAFLSPEQRRAVAWAQHEGKESPEQQGRSTAWGLQDWSRPSWSLVLTISFLGHLL

SEQ ID NO: 12939 - protein, 663 aa, Homo Sapiens
TFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEALCENHLGPAPPYSISNFSIHLLCQHTKPATPQPHPSTTAICQTAVWYAVSWAPGAQGWLQACHDQFPDEFLDAICSNLSFSALSGSNRRLVKRLCAGLLPPPTSCPEGLPPVPLTPDIFWGCFLENETLWAERLCGEASLQAVPPSNQAWVQHVCQGPTPDVTASPPCHIGPCGERCPDGGSFLVMVCANDTMYEVLVPFWPWLAGQCRISRGGNDTCFLEGLLGPLLPSLPPLGPSPLCLTPGPFLLGMLSQLPRCQSSVPALAHPTRLHYLLRLLTFLLGPGAGGAEAQGMLGRALLLSSLPDNCSFWDAFRPEGRRSVLRTIGEYLEQDEEQPTPSGFEPTVNPSSGISKMELLACFSVSALPEGKLLEQ

SEQ ID NO: 12940 - protein, 119 aa, Homo Sapiens
  misc_feature (1)..(1): Xaa can be any naturally occurring amino acid
XSLAAIRDYSPGMRPEQKEALAKRLLAPELFGEVPAWPQELLWAVLPLLPHLPLENFLQLSPHQIQALEDSWPAAGLGPGHARHVLRSLVNQSVQDGEEQVRRWHMNFWVCCAHLEERC

SEQ ID NO: 12941 - protein, 346 aa, Homo Sapiens
MTATLAAAADIATMVSGSSGLAAARLLSRSFLLPQNGIRHCSYTASRQHLYVDKNTKIICQGFTGKQGTFHSQQALEYGTKLVGGTTPGKGGQTHLGLPVFNTVKEAKEQTGATASVIYVPPPFAAAAINEAIEAEIPLVVCITEGIPQQDMVRVKHKLLRQEKTRLIGPNCPGVINPGECKIGIMPGHIHKKGRIGIVSRSGTLTYEAVHQTTQVGLGQSLCVGIGGDPFNGTDFIDCLEIFLNDSATEGIILIGEIGGNAEENAAEFLKQHNSGPNSKPVVSFIAGLTAPPGRRMGHAGAIIAGGKGGAKEKISALQSAGVVVSMSPAQLGTTIYKEFEKRKML

SEQ ID NO: 12942 - protein, 105 aa, Homo Sapiens
  misc_feature (1)..(1): Xaa can be any naturally occurring amino acid
XTLAAAADIATMVSGSSGLAAARLLSRSFLLPQNGIRHCSYTASRQHLYVDKNTKIICQGFTGKQELLLLTRHLSQPAGIGIWHQTRWRNHSRERRPDTSGLTCL

SEQ ID NO: 12943 - protein, 328 aa, Homo Sapiens
MSAAGLLAPAPAQAGAPPAPEYYPEEDEELESAEDDERSCRGRESDEDTEDASETDLAKHDEEDYVEMKEQMYQDKLASLKRQLQQLQEGTLQEYQKRMKKLDQQYKERIRNAELFLQLETEQVERNYIKEKKAAVKEFEDKKVELKENLIAELEEKKKMIENEKLTMELTGDSMEVKPIMTRKLRRRPNDPVPIPDKRRKPAPAQLNYLLTDEQIMEDLRTLNKLKSPKRPASPSSPEHLPATPAESPAQRFEARIEDGKLYYDKRWYHKSQAIYLESKDNQKLSCVISSVGANEIWVRKTSDSTKMRIYLGQLQRGLFVIRRRSAA

SEQ ID NO: 12944 - protein, 29 aa, Homo Sapiens
MKYSCCALVLAVLGTELLGSLCSTVRSPR

SEQ ID NO: 12945 - protein, 56 aa, Homo Sapiens
MKYSCCALVLAVLGTELLGSLCSTVRSPRFRGRIQQERKNIRPNIILVLTDDQDVE

SEQ ID NO: 12946 - protein, 76 aa, Homo Sapiens
MKYSCCALVLAVLGTELLGSLCSTVRSPRFRGRIQQERKNIRPNIILVLTDDQDVELGSLQVMNKTRKIMEHGGAT

SEQ ID NO: 12947 - protein, 85 aa, Homo Sapiens
MKYSCCALVLAVLGTELLGSLCSTVRSPRFRGRIQQERKNIRPNIILVLTDDQDVELGSLQVMNKTRKIMEHGGATFINAFVTTP

SEQ ID NO: 12948 - protein, 172 aa, Homo Sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYT

SEQ ID NO: 12949 - protein, 871 aa, Homo Sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 12950 - protein, 871 aa, Homo Sapiens; identical to SEQ ID NO: 12949

SEQ ID NO: 12951 - protein, 871 aa, Homo Sapiens; identical to SEQ ID NO: 12949

SEQ ID NO: 12952 - protein, 871 aa, Homo Sapiens; identical to SEQ ID NO: 12949

SEQ ID NO: 12953 - protein, 669 aa, Homo Sapiens
MVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRMLLFLVPCSAPLTSRAMVSDASF

SEQ ID NO: 12954 - protein, 131 aa, Homo Sapiens
  misc_feature (1)..(1): Xaa can be any naturally occurring amino acid
XREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNPHKYSAHGRTRHFESATRTTNGAQKLSRI

SEQ ID NO: 12955 - protein, 189 aa, Homo Sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSK

SEQ ID NO: 12956 - protein, 870 aa, Homo Sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 12957 - protein, 870 aa, Homo Sapiens; identical to SEQ ID NO: 12956

SEQ ID NO: 12958 - protein, 867 aa, Homo Sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLDGGSYEQYRQFQRRKWPEMKRPSSKSLGQLWEGWEG

SEQ ID NO: 12959 - protein, 207 aa, Homo Sapiens
  misc_feature (1)..(1): Xaa can be any naturally occurring amino acid
XEVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRGQLWEGWEG

SEQ ID NO: 12960 - protein, 374 aa, Homo Sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSYCYRYRCAARSQNTPDSSASNLGFRCAADRLPTMD

SEQ ID NO: 12961 - protein, 354 aa, Homo Sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPSYCYRYRCAARSQNTPDSSASNLGFRCAADRLPTMD

SEQ ID NO: 12962 - protein, 426 aa, Homo Sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSQEYYDPYFQDVASEMLRRHTASRWKAFSSLEPCCSIRRHQQYAAIERLTCGKFELRCASLRKIDCLNTNIACSYSMRQDGPRLHCVD

SEQ ID NO: 12963 - protein, 349 aa, Homo Sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSYCYRYRCAARSQNTPDSSASNLGFRCAADRLPTMD

SEQ ID NO: 12964 - protein, 242 aa, Homo Sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEVDAFPPNGYGLYNIVGNAWEWTSDWWTVHHSVEETLNPKGPPSGKDRVKKGGSYMCHRSYCYRYRCAARSQNTPDSSASNLGFRCAADRLPTMD

SEQ ID NO: 12965 - protein, 304 aa, Homo Sapiens
HGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSGRCLCWAGASCSRSPSFSQSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLG

SEQ ID NO: 12966 - protein, 51 aa, Homo Sapiens
MARHGLPLLPLLSLLVGAWLKLGILSGRKSIGQKLRCLDGALSLRTLSLMS

SEQ ID NO: 12967 - protein, 232 aa, Homo Sapiens
MARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSVLWWLPVEKAFWRQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 12968 - protein, 183 aa, Homo Sapiens
MARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVKFTHGGTGSSQTAPTCGRESSPRETKLRMASMESPQ

SEQ ID NO: 12969 - protein, 352 aa, Homo Sapiens
MARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRVLLCCPGWSAVAQSQLTTASNCQALAILPPQLLKYLGLQDGQHSRFSLRQPRFPLCCRRRPAARGAVSSRVVTRRKAF

SEQ ID NO: 12970 - protein, 165 aa, Homo Sapiens
MARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSVLWWLPVEKAFWRQVKFTHGGTGSSQTAPTCGRESSPRETKLRMASMESPQ

SEQ ID NO: 12971 - protein, 150 aa, Homo Sapiens
MARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKVKFTHGGTGSSQTAPTCGRESSPRETKLRMASMESPQ

SEQ ID NO: 12972 - protein, 102 aa, Homo Sapiens
MARHGLPLLPLLSLLVGAWLKLGNGQATSMVQLQGGRFLMGTNSPDSRDGDGPVREATVKPFAIDIFPVTNKDFRSSLPMGELVPAKPHQPVAGKVPQGRQS

SEQ ID NO: 12973 - protein, 213 aa, Homo Sapiens
MFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 12974 - protein, 236 aa, Homo Sapiens
MRAHAQRGRGCTRRSAAVLMARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 12975 - protein, 305 aa, Homo Sapiens
MRAHAQRGRGCTRRSAAVLMARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 12976 - protein, 320 aa, Homo Sapiens
MRAHAQRGRGCTRRSAAVLMARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 12977 - protein, 358 aa, Homo Sapiens
MRAHAQRGRGCTRRSAAVLMARHGLPLLPLLSLLVGAWLKLGNGQATSMVQLQGGRFLMGTNSPDSRDGDGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGWATLQIQPQTTSVSAVLQTQAGRQGSCKQPGGDKEKSLLGSLSFPGHVANSAIPSSRASASGKNFPFPVSHPSVAGASHQGRRGLSLLCFGEGAQCVLTMAGGQVFLLEAKYY

SEQ ID NO: 12978 - protein, 294 aa, Homo Sapiens
MRAHAQRGRGCTRRSAAVLMARHGLPLLPLLSLLVGAWLKLGNGQATSMVQLQGGRFLMGTNSPDSRDGDGPVREATVKPFAIDIFPVTNKDFRYIRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVT

SEQ ID NO: 12979 - protein, 747 aa, Homo Sapiens
MGRGPWDAGPSRRLLPLLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKVRRHSCAVWAQVKDSSLMLLQMAGVGLGSLAVVIILTFLSFSAV

SEQ ID NO: 12980 - protein, 757 aa, Homo Sapiens
MGRGPWDAGPSRRLLPLLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKVRRHSCAVWAQVKEIPCNCNFLRLHIHRANSGDTQIRHSCCCRWRVLDWVPWLL

SEQ ID NO: 12981 - protein, 722 aa, Homo Sapiens
MGRGPWDAGPSRRLLPLLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKIRHSCCCRWRVLDWVPWLL

SEQ ID NO: 12982 - protein, 45 aa, Homo Sapiens
VITALYYESQVNGISIKFILMRSVYIIVTGDQNPIHTTLSKELHS

SEQ ID NO: 12983 - protein, 281 aa, Homo Sapiens
  misc_feature (1)..(1): Xaa can be any naturally occurring amino acid
XGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAGSRNSHGRNTHIKEVDLLEDDGSFNISIFNETCLKLNRRSRKVGSEHMYQFTVLGQRWYLANFSHATSFNFTTREQV

SEQ ID NO: 12984 - protein, 706 aa, Homo Sapiens
  misc_feature (1)..(1): Xaa can be any naturally occurring amino acid
XLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKIRHSCCCRWRVLDWVPWLL

SEQ ID NO: 12985 - protein, 629 aa, Homo Sapiens
MTAEGPSPPARWHRRLPGLWAAALLLLGLPRLSVRADGKFFVLESQNGSQGLQLEAARLSCKSRGAHLASADELRRVVQDCSFAVCTTGWLADGTLGTTVCSKGSGEQQIMRAVDVRIESNPVPGGTYSALCIKDEEKPCGDPPSFPHTILQGRTGLEMGDELLYVCAPGHIMGHRETAFTLLCNSCGEWYGLVQACGKDEAEAHIDYEDNFPDDRSVSFRELMEDSRTEADEDRGQGDSSEEAPKQDRLVSISVGRENIARDKVFVPTTGLPGAGSSVPADSPGSRLLQKHLFWFPAEAFHKPGLEKEVDDDTKKQFSAGDNHSGVKLVPGEPETKVIYGNTDGPSGPFVGKNDSKAGDPVVSSSDESWLDGYPVTEGAWRKTEAEEEEDGDRGDGSVGLDENVLVTPDQPILVEVKKPKSSTLTPSEGMTHSSVLPSQMLDVEALALRPVNASETEGIGDGDLTKYQSTLPWRFITEESPMATLSYELTSSTLEILTVNTVKQTPNHIPSTIMATTQPPVETTVPEIQDSFPYLLSEDFFGQEGPGPGASEELHPTLESCVGDGCPGLSRGPVIATIVTVLCLLLLLAGVGMVWGYRKCQHKSSVYKLNVGQRQARHYHQQIEMEKV

SEQ ID NO: 12986 - protein, 243 aa, Homo Sapiens
  misc_feature (1)..(1): Xaa can be any naturally occurring amino acid
XAEGPSPPARWHRRLPGLWAAALLLLGLPRLSVRADGKFFVLESQNGSQGLQLEAARLSCKSRGAHLASADELRRVVQDCSFAVCTTGWLADGTLGTTVCSKGSGEQQIMRAVDVRIESNPVPGGTYSALCIKDEDEAEAHIDYEDNFPDDRSVSFRELMEDSRTEADEDRGQGDSSEEAPKQDRLVSISVGRENIARDKVFVPTTGLPGAGSSVPADSPGSRLLQKHLFWFPAEAFHKPGLE

SEQ ID NO: 12987 - protein, 3571 aa, Homo Sapiens
MWPRLAFCCWGLALVSGWATFQQMSPSRNFSFRLFPETAPGAPGSIPAPPAPGDEAAGSRVERLGQAFRRRVRLLRELSERLELVFLVDDSSSVGEVNFRSELMFVRKLLSDFPVVPTATRVAIVTFSSKNYVVPRVDYISTRRARQHKCALLLQEIPAISYRGGGTYTKGAFQQAAQILLHARENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGPGGWGAANRLDYSYDDFLDTVQETATSIGNAKSSRIKRSAPLSDYKIKLIFNITASVPLPDERNDTLEWENQQRLLQTLETITNKLKRTLNKDPMYSFQLASEILIADSNSLETKKASPFCRPGSVLRGRMCVNCPLGTYYNLEHFTCESCRIGSYQDEEGQLECKLCPSGMYTEYIHSRNISDCKAQCKQGTYSYSGLETCESCPLGTYQPKFGSRSCLSCPENTSTVKRGAVNISACGVPCPEGKFSRSGLMPCHPCPRDYYQPNAGKAFCLACPFYGTTPFAGSRSITECSSFSSTFSAAEESVVPPASLGHIKKRHEISSQVFHECFFNPCHNSGTCQQLGRGYVCLCPLGYTGLKCETDIDECSPLPCLNNGVCKDLVGEFICECPSGYTGQRCEENINECSSSPCLNKGICVDGVAGYRCTCVKGFVGLHCETEVNECQSNPCLNNAVCEDQVGGFLCKCPPGFLGTRCGKNVDECLSQPCKNGATCKDGANSFRCLCAAGFTGSHCELNINECQSNPCRNQATCVDELNSYSCKCQPGFSGKRCETEQSTGFNLDFEVSGIYGYVMLDGMLPSLHALTCTFWMKSSDDMNYGTPISYAVDNGSDNTLLLTDYNGWVLYVNGREKITNCPSVNDGRWHHIAITWTSANGIWKVYIDGKLSDGGAGLSVGLPIPGGGALVLGQEQDKKGEGFSPAESFVGSISQLNLWDYVLSPQQVKSLATSCPEELSKGNVLAWPDFLSGIVGKVKIDSKSIFCSDCPRLGGSVPHLRTASEDLKPGSKVNLFCDPGFQLVGNPVQYCLNQGQWTQPLPHCERISCGVPPPLENGFHSADDFYAGSTVTYQCNNGYYLLGDSRMFCTDNGSWNGVSPSCLDVDECAVGSDCSEHASCLNVDGSYICSCVPPYTGDGKNCAEPIKCKAPGNPENGHSSGEIYTVGAEVTFSCQEGYQLMGVTKITCLESGEWNHLIPYCKAVSCGKPAIPENGCIEELAFTFGSKVTYRCNKGYTLAGDKESSCLANSSWSHSPPVCEPVKCSSPENINNGKYILSGLTYLSTASYSCDTGYSLQGPSIIECTASGIWDRAPPACHLVFCGEPPAIKDAVITGNNFTFRNTVTYTCKEGYTLAGLDTIECLADGKWSRSDQQCLAVSCDEPPIVDHASPETAHRLFGDIAFYYCSDGYSLADNSQLLCNAQGKWVPPEGQDMPRCIAHFCEKPPSVSYSILESVSKAKFAAGSVVSFKCMEGFVLNTSAKIECMRGGQWNPSPMSIQCIPVRCGEPPSIMNGYASGSNYSFGAMVAYSCNKGFYIKGEKKSTCEATGQWSSPIPTCHPVSCGEPPKVENGFLEHTTGRIFESEVRYQCNPGYKSVGSPVFVCQANRHWHSESPLMCVPLDCGKPPPIQNGFMKGENFEVGSKVQFFCNEGYELVGDSSWTCQKSGKWNKKSNPKCMPAKCPEPPLLENQLVLKELTTEVGVVTFSCKEGHVLQGPSVLKCLPSQQWNDSFPVCKIVLCTPPPLISFGVPIPSSALHFGSTVKYSCVGGFFLRGNSTTLCQPDGTWSSPLPECVPVECPQPEEIPNGIIDVQGLAYLSTALYTCKPGFELVGNTTTLCGENGHWLGGKPTCKAIECLKPKEILNGKFSYTDLHYGQTVTYSCNRGFRLEGPSALTCLETGDWDVDAPSCNAIHCDSPQPIENGFVEGADYSYGAIIIYSCFPGFQVAGHAMQTCEESGWSSSIPTCMPIDCGLPPHIDFGDCTKLKDDQGYFEQEDDMMEVPYVTPHPPYHLGAVAKTWENTKESPATHSSNFLYGTMVSYTCNPGYELLGNPVLICQEDGTWNGSAPSCISIECDLPTAPENGFLRFTETSMGSAVQYSCKPGHILAGSDLRLCLENRKWSGASPRCEAISCKKPNPVMNGSIKGSNYTYLSTLYYECDPGYVLNGTERRTCQDDKNWDEDEPICIPVDCSSPPVSANGQVRGDEYTFQKEIEYTCNEGFLLEGARSRVCLANGSWSGATPDCVPVRCATPPQLANGVTEGLDYGFMKEVTFHCHEGYILHGAPKLTCQSDGNWDAEIPLCKPVNCGPPEDLAHGFPNGFSFIHGGHIQYQCFPGYKLHGNSSRRCLSNGSWSGSSPSCLPCRCSTPVIEYGTVNGTDFDCGKAARIQCFKGFKLLGLSEITCEADGQWSSGFPHCEHTSCGSLPMIPNAFISETSSWKENVITYSCRSGYVIQGSSDLICTEKGVWSQPYPVCEPLSCGSPPSVANAVATGEAHTYESEVKLRCLEGYTMDTDTDTFTCQKDGRWFPERISCSPKKCPLPENITHILVHGDDFSVNRQVSVSCAEGYTFEGVNISVCQLDGTWEPPFSDESCSPVSCGKPESPEHGFVVGSKYTFESTIIYQCEPGYELEGNRERVCQENRQWSGGVAICKETRCETPLEFLNGKADIENRTTGPNVVYSCNRGYSLEGPSEAHCTENGTWSHPVPLCKPNPCPVPFVIPENALLSEKEFYVDQNVSIKCREGFLLQGHGIITCNPDETWTQTSAKCEKISCGPPAHVENAIARGVHYQYGDMITYSCYSGYMLEGFLRSVCLENGTWTSPPICRAVCRFPCQNGGICQRPNACSCPEGWMGRLCEEPICILPCLNGGRCVAPYQCDCPPGWTGSRCHTAVCQSPCLNGGKCVRPNRCHCLSSWTGHNCSRKRRTGF

SEQ ID NO: 12988 - protein, 868 aa, Homo Sapiens
MWPRLAFCCWGLALVSGWATFQQMSPSRNFSFRLFPETAPGAPGSIPAPPAPGDEAAGSRVERLGQAFRRRVRLLRELSERLELVFLVDDSSSVGEVNFRSELMFVRKLLSDFPVVPTATRVAIVTFSSKNYVVPRVDYISTRRARQHKCALLLQEIPAISYRGGGTYTKGAFQQAAQILLHARENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGN

SEQ ID NO: 12989 - protein, 3574 aa, Homo Sapiens
MWPRLAFCCWGLALVSGWATFQQMSPSRNFSFRLFPETAPGAPGSIPAPPAPGDEAAGSRVERLGQAFRRRVRLLRELSERLELVFLVDDSSSVGEVNFRSELMFVRKLLSDFPVVPTATRVAIVTFSSKNYVVPRVDYISTRRARQHKCALLLQEIPAISYRGGGTYTKGAFQQAAQILLHARENSTKVVFLITDGYSNGGDPRPIAASLRDSGVEIFTFGIWQGNIRELNDMASTPKEEHCYLLHSFEEFEALARRALHEDLPSGSFIQDDMVHCSYLCDEGKDCCDRMGSCKCGTHTGHFECICEKGYYGKGLQYECTACPSGTYKPEGSPGGISSCIPCPDENHTSPPGSTSPEDCVCREGYRASGQTCELVHCPALKPPENGYFIQNTCNNHFNAACGVRCHPGFDLVGSSIILCLPNGLWSGSESYCRVRTCPHLRQPKHGHISCSTREMLYKTTCLVACDEGYRLEGSDKLTCQGNSQWDGPEPRCVERHCSTFQMPKDVIISPHNCGKQPAKFGTICYVSCRQGFILSGVKEMLRCTTSGKWNVGVQAAVCKDVEAPQINCPKDIEAKTLEQQDSANVTWQIPTAKDNSGEKVSVHVHPAFTPPYLFPIGDVAIVYTATDLSGNQASCIFHIKVIDAEPPVIDWCRSPPPVQVSEKVHAASWDEPQFSDNSGAELVITRSHTQGDLFPQGETIVQYTATDPSGNNRTCDIHIVIKGSPCEIPFTPVNGDFICTPDNTGVNCTLTCLEGYDFTEGSTDKYYCAYEDGVWKPTYTTEWPDCAKKRFANHGFKSFEMFYKAARCDDTDLMKKFSEAFETTLGKMVPSFCSDAEDIDCRLEENLTKKYCLEYNYDYENGFAIGPGGWGAANRLDYSYDDFLDTVQETATSIGNAKSSRIKRSAPLSDYKIKLIFNITASVPLPDERNDTLEWENQQRLLQTLETITNKLKRTLNKDPMYSFQLASEILIADSNSLETKKASPFCRPGSVLRGRMCVNCPLGTYYNLEHFTCESCRIGSYQDEEGQLECKLCPSGMYTEYIHSRNISDCKAQCKQGTYSYSGLETCESCPLGTYQPKFGSRSCLSCPENTSTVKRGAVNISACGVPCPEGKFSRSGLMPCHPCPRDYYQPNAGKAFCLACPFYGTTPFAGSRSITECSSFSSTFSAAEESVVPPASLGHIKKRHEISSQVFHECFFNPCHNSGTCQQLGRGYVCLCPLGYTGLKCETDIDECSPLPCLNNGVCKDLVGEFICECPSGYTGQRCEENINECSSSPCLNKGICVDGVAGYRCTCVKGFVGLHCETEVNECQSNPCLNNAVCEDQVGGFLCKCPPGFLGTRCGKNVDECLSQPCKNGATCKDGANSFRCLCAAGFTGSHCELNINECQSNPCRNQATCVDELNSYSCKCQPGFSGKRCETEQSTGFNLDFEVSGIYGYVMLDGMLPSLHALTCTFWMKSSDDMNYGTPISYAVDNGSDNTLLLTDYNGWVLYVNGREKITNCPSVNDGRWHHIAITWTSANGIWKVYIDGKLSDGGAGLSVGLPIPGMLGGGALVLGQEQDKKGEGFSPAESFVGSISQLNLWDYVLSPQQVKSLATSCPEELSKGNVLAWPDFLSGIVGKVKIDSKSIFCSDCPRLGGSVPHLRTASEDLKPGSKVNLFCDPGFQLVGNPVQYCLNQGQWTQPLPHCERISCGVPPPLENGFHSADDFYAGSTVTYQCNNGYYLLGDSRMFCTDNGSWNGVSPSCLDVDECAVGSDCSEHASCLNVDGSYICSCVPPYTGDGKNCAEPIKCKAPGNPENGHSSGEIYTVGAEVTFSCQEGYQLMGVTKITCLESGEWNHLIPYCKAVSCGKPAIPENGCIEELAFTFGSKVTYRCNKGYTLAGDKESSCLANSSWSHSPPVCEPVKCSSPENINNGKYILSGLTYLSTASYSCDTGYSLQGPSIIECTASGIWDRAPPACHLVFCGEPPAIKDAVITGNNFTFRNTVTYTCKEGYTLAGLDTIECLADGKWSRSDQQCLAVSCDEPPIVDHASPETAHRLFGDIAFYYCSDGYSLADNSQLLCNAQGKWVPPEGQDMPRCIAHFCEKPPSVSYSILESVSKAKFAAGSVVSFKCMEGFVLNTSAKIECMRGGQWNPSPMSIQCIPVRCGEPPSIMNGYASGSNYSFGAMVAYSCNKGFYIKGEKKSTCEATGQWSSPIPTCHPVSCGEPPKVENGFLEHTTGRIFESEVRYQCNPGYKSVGSPVFVCQANRHWHSESPLMCVPLDCGKPPPIQNGFMKGENFEVGSKVQFFCNEGYELVGDSSWTCQKSGKWNKKSNPKCMPAKCPEPPLLENQLVLKELTTEVGVVTFSCKEGHVLQGPSVLKCLPSQQWNDSFPVCKIVLCTPPPLISFGVPIPSSALHFGSTVKYSCVGGFFLRGNSTTLCQPDGTWSSPLPECVPVECPQPEEIPNGIIDVQGLAYLSTALYTCKPGFELVGNTTTLCGENGHWLGGKPTCKAIECLKPKEILNGKFSYTDLHYGQTVTYSCNRGFRLEGPSALTCLETGDWDVDAPSCNAIHCDSPQPIENGFVEGADYSYGAIIIYSCFPGFQVAGHAMQTCEESGWSSSIPTCMPIDCGLPPHIDFGDCTKLKDDQGYFEQEDDMMEVPYVTPHPPYHLGAVAKTWENTKESPATHSSNFLYGTMVSYTCNPGYELLGNPVLICQEDGTWNGSAPSCISIECDLPTAPENGFLRFTETSMGSAVQYSCKPGHILAGSDLRLCLENRKWSGASPRCEAISCKKPNPVMNGSIKGSNYTYLSTLYYECDPGYVLNGTERRTCQDDKNWDEDEPICIPVDCSSPPVSANGQVRGDEYTFQKEIEYTCNEGFLLEGARSRVCLANGSWSGATPDCVPVRCATPPQLANGVTEGLDYGFMKEVTFHCHEGYILHGAPKLTCQSDGNWDAEIPLCKPVNCGPPEDLAHGFPNGFSFIHGGHIQYQCFPGYKLHGNSSRRCLSNGSWSGSSPSCLPCRCSTPVIEYGTVNGTDFDCGKAARIQCFKGFKLLGLSEITCEADGQWSSGFPHCEHTSCGSLPMIPNAFISETSSWKENVITYSCRSGYVIQGSSDLICTEKGVWSQPYPVCEPLSCGSPPSVANAVATGEAHTYESEVKLRCLEGYTMDTDTDTFTCQKDGRWFPERISCSPKKCPLPENITHILVHGDDFSVNRQVSVSCAEGYTFEGVNISVCQLDGTWEPPFSDESCSPVSCGKPESPEHGFVVGSKYTFESTIIYQCEPGYELEGNRERVCQENRQWSGGVAICKETRCETPLEFLNGKADIENRTTGPNVVYSCNRGYSLEGPSEAHCTENGTWSHPVPLCKPNPCPVPFVIPENALLSEKEFYVDQNVSIKCREGFLLQGHGIITCNPDETWTQTSAKCEKISCGPPAHVENAIARGVHYQYGDMITYSCYSGYMLEGFLRSVCLENGTWTSPPICRAVCRFPCQNGGICQRPNACSCPEGWMGRLCEEPICILPCLNGGRCVAPYQCDCPPGWTGSRCHTAVCQSPCLNGGKCVRPNRCHCLSSWTGHNCSRKRRTGF

SEQ ID NO: 12990 - protein, 229 aa, Homo Sapiens
MPAAGPPLLLLGTPGSGKTALLFAAALEAAGEGQGPVLFLTRRPLQSMPRGTGTTLDPMRLQKIRFQYPPSTRELFRLLCSAHEAPGPAPSLLLLDGLEEYLAEDPEPQEAAYLIALLLDTAAHFSHRLGPGRDCGLMVALQTQEEAGSGDVLHLALLQRYFPAQCWLQPDAPGPGEHGLRACLEPGGLGPRTEWWVTFRSDGEMMIAPWPTQAGDPSSGKGSSSGGQP

SEQ ID NO: 12991 - protein, 352 aa, Homo Sapiens
MFRGLSSWLGLQQPVAGGGQPNGDAPPEQPSETVAESAEEELQQAGDQELLHQAKDFGNYLFNFASAATKKITESVAETAQTIKKSVEEGKIDGIIDKTIIGDFQKEQKKFVEEQHTKKSEAAVPPWVDTNDEETIQQQILALSADKRNFLRDPPAGVQFNFDFDQMYPVALVMLQEDELLSKMRFALVPKLVKEEVFWRNYFYRVSLIKQSAQLTALAAQQQAAGKEEKSNGREQDLPLAEAVRPKTPPVVIKSQLKTQEDEEEISTSPGVSEFVSDAFDACNLNQEDLRKEMEQLVLDKKQEETAVLEEDSADWEKELQQELQEYEVVTESEKRDENWDKEIEKMLQEEN

SEQ ID NO: 12992 - protein, 134 aa, Homo Sapiens
MSPLRPLLLALALASVPCAQGACPASADLKHSDGTRTCAKLYDKSDPYYENCCGGAELSLESGADLPYLPSNWANTASSLVVAPRCELTVWSRQGKAGKTHKFSAGTYPRLEEYRRGILGDWSNAISALYCRCS

SEQ ID NO: 12993 - protein, 111 aa, Homo Sapiens
MKILVALAVFFLVSTQLFAEEIGANDDLNYWSDWYDSDQIKEELPEPFEHLLQRIARRPKPQQFFGLMGKRDADSSIEKQVALLKALYGHGQISHKMAYERSAMQNYERRR

SEQ ID NO: 12994 - protein, 129 aa, Homo Sapiens
MKILVALAVFFLVSTQLFAEEIGANDDLNYWSDWYDSDQIKEELPEPFEHLLQRIARRPKPQQFFGLMGKRDADSSIEKQVALLKALYGHGQISHKRHKTDSFVGLMGKRALNSVAYERSAMQNYERRR

SEQ ID NO: 12995 - protein, 114 aa, Homo Sapiens
MKILVALAVFFLVSTQLFAEEIGANDDLNYWSDWYDSDQIKEELPEPFEHLLQRIARRPKPQQFFGLMGKRDAGHGQISHKRHKTDSFVGLMGKRALNSVAYERSAMQNYERRR

SEQ ID NO: 12996 - protein, 103 aa, Homo Sapiens
MRIMLLFTAILAFSLAQSFGAVCKEPQEEVVPGGGRSKRDPDLYQLLQRLFKSHSSLEGLLKALSQASTDPKESTSPEKHSPTDVNQENVPSFGILKYPPRAE

SEQ ID NO: 12997 - protein, 103 aa, Homo Sapiens; identical to SEQ ID NO: 12996

SEQ ID NO: 12998 - protein, 103 aa, Homo Sapiens; identical to SEQ ID NO: 12996

SEQ ID NO: 12999 - protein, 121 aa, Homo Sapiens
MRIMLLFTAILAFSLAQSFGAVCKEPQEEVVPGGGRSKRDPDLYQLLQRLFKSHSSLEGLLKALSQASTDPKESTSPEKRDMHDFFVGLMGKRSVQPDSPTDVNQENVPSFGILKYPPRAE

SEQ ID NO: 13000 - protein, 121 aa, Homo Sapiens; identical to SEQ ID NO: 12999

SEQ ID NO: 13001 - protein, 121 aa, Homo Sapiens; identical to SEQ ID NO: 12999

SEQ ID NO: 13002 - protein, 121 aa, Homo Sapiens; identical to SEQ ID NO: 12999

SEQ ID NO: 13003 - protein, 135 aa, Homo Sapiens
MRIMLLFTAILAFSLAQSFGAVCKEPQEEVVPGGGRSKRDPDLYQLLQRLFKSHSSLEGLLKALSQASTDPKESTSPEKRDMHDFFVGLMGKRSVQPEGKTGPFLPSVRVPRPLHPNQLGSTGKSSLGTEEQRPL

SEQ ID NO: 13004 - protein, 135 aa, Homo Sapiens; identical to SEQ ID NO: 13003

SEQ ID NO: 13005 - protein, 135 aa, Homo Sapiens; identical to SEQ ID NO: 13003

SEQ ID NO: 13006 - protein, 96 aa, Homo Sapiens
MLPCLALLLLMELSVCTVAGDGGEEQTLSTEAETWEGAGPSIQLQLQEVKTGKASQFFGLMGKRVGAYQLEHTFQGLLGKRSLFTEGREDEAQGSE

SEQ ID NO: 13007 - protein, 76 aa, Homo Sapiens
MLPCLALLLLMELSVCTVAGDGGEEQTLSTEAETWEGAGPSIQLQLQEVKTGKASQFFGLMGKRVGGREDEAQGSE

SEQ ID NO: 13008 - protein, 107 aa, Homo Sapiens
MLPCLALLLLMELSVCTVAGDGGEEQTLSTEAETWEGAGPSIQLQLQEVKTGKASQFFGLMGKRVGGRPLIQPRRKKAYQLEHTFQGLLGKRSLFTEGREDEAQGSE

SEQ ID NO: 13009 - protein, 87 aa, Homo Sapiens
MLPCLALLLLMELSVCTVAGDGGEEQTLSTEAETWEGAGPSIQLQLQEVKTGKASQFFGLMGKRVGGRPLIQPRRKKGREDEAQGSE

SEQ ID NO: 13010 - protein, 113 aa, Homo Sapiens
MLPCLALLLLMELSVCTVAGDGGEEQTLSTEAETWVIVALEEGAGPSIQLQLQEVKTGKASQFFGLMGKRVGGRPLIQPRRKKAYQLEHTFQGLLGKRSLFTEGREDEAQGSE

SEQ ID NO: 13011 - protein, 53 aa, Homo Sapiens
MLPCLALLLLMELSVCTVAGDGGEEQTLSTEAETWVIVALEVLLGRGSDEGRG

SEQ ID NO: 13012 - protein, 187 aa, Homo Sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQA

SEQ ID NO: 13013 - protein, 199 aa, Homo Sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 13014 - protein, 199 aa, Homo Sapiens; identical to SEQ ID NO: 13013

SEQ ID NO: 13015 - protein, 220 aa, Homo Sapiens
MSAFSLALALVSSPQPPPPIGMANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 13016 - protein, 192 aa, Homo Sapiens
MKSLSLLLAVALDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGP

SEQ ID NO: 13017 - protein, 156 aa, Homo Sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSMGHAMPVEFTIPACLPRGAALRSPWR

SEQ ID NO: 13018 - protein, 466 aa, Homo Sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVEMGFHHVGQAALELLTSVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 13019 - protein, 504 aa, Homo Sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKVQCSTSLYLSLVTLSPHPISKPMEGGCWCGRQNLGLEFTLIWVKTWHYILTVGLFEHAT

SEQ ID NO: 13020 - protein, 448 aa, Homo Sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 13021 - protein, 361 aa, Homo Sapiens
MKSLSLLLAVALGLATAVSAGPAVIECWFVEDASGKGLAKRPGALLLRQGPGEPPPRPDLDPELYLSVHVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 13022 - protein, 468 aa, Homo Sapiens
MGTQEGWCLLLCLALSGAAETKPHPAEGQWRAVDVVLDCFLAKDGAHRGALASSEDRARASLVLKQVPVLDDGSLEDFTDFQGGTLAQDDPPIIFEASVDLVQIPQAEALLHADCSGKEVTCEISRYFLQMTETTVKTAAWFMANMQVSGGGPSISLVMKTPRVTKNEALWHPTLNLPLSPQGTVRTAVEFQVMTQTQSLSFLLGSSASLDCGFSMAPGLDLISVEWRLQHKGRGQLVYSWTAGQGQAVRKGATLEPAQLGMARDASLTLPGLTIQDEGTYICQITTSLYRAQQIIQLNIQASPKVRLSLANEALLPTLICDIAGYYPLDVVVTWTREELGGSPAQVSGASFSSLRQSVAGTYSISSSLTAEPGSAGATYTCQVTHISLEEPLGASTQVVPPERRTALGVIFASSLFLLALMFLGLQRRQAPTGLGLLQAERWETTSCADTQSSHLHEDRTARVSQPS

SEQ ID NO: 13023 - protein, 185 aa, Homo Sapiens
MGTQEGWCLLLCLALSGAAETMDLVQIPQAEALLHADCSGKEVTCEISRYFLQMTETTVKTAAWFMANMQVSGGGPSISLVMKTPRVTKNEALWHPTLNLPLSPQGTVRTAVEFQVMTQTQSLSFLLGSSASLDCGFSMAPGLDLISVEWRLQHKGRGRGDLHLPDHHLSVPSSADHPAQHPSFP

SEQ ID NO: 13024 - protein, 96 aa, Homo Sapiens
MDFSSNGKYLATCADDRTIRIWSTKDFLQREHRSMRANVELDHATLVRFSPDCRAFIVWLANGDTLRVFKMTKREDGGYTFTATPEDFPKKHKAPV

SEQ ID NO: 13025 - protein, 43 aa, Homo Sapiens
MELSQMSELMGLSVLLGLLALMATAAVARGWLRAGEERSGRPA

SEQ ID NO: 13026 - protein, 43 aa, Homo Sapiens; identical to SEQ ID NO: 13025

SEQ ID NO: 13027 - protein, 46 aa, Homo Sapiens
MELSQMSELMGLSVLLGLLALMATAAVARGWLRAGEERSGRPACGQ

SEQ ID NO: 13028 - protein, 107 aa, Homo Sapiens
MELSQMSELMGLSVLLGLLALMATAAVARGWLRAGEERSGRPACQKANGFPPDKSSGSKKQKQYQRIRKEKPQQHNFTHRLLAAALKMIAPSASGAPRTSCSESTAA

SEQ ID NO: 13029 - protein, 176 aa, Homo Sapiens
MELSQMSELMGLSVLLGLLALMATAAVARGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLSLHRLAGQRGHPPCLQDDQAGGWGLHLHSHPRGLP

SEQ ID NO: 13030 - protein, 447 aa, Homo Sapiens
MELSQMSELMGLSVLLGLLALMATAAVARGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 13031 - protein, 446 aa, Homo Sapiens [sequence omitted]

SEQ ID NO: 13032 - protein, 75 aa, Homo Sapiens
MELSQMSELMGLSVLLGLLALMATAAVARGWLRAGEERSGRPAWPRSFFPVGIGEHLQSFTTCQLCDSIKYLLQK

SEQ ID NO: 13033 - protein, 54 aa, Homo Sapiens
MELSQMSELMGLSVLLGLLALMATAAVARGWLRAGEERSGRPAWSCSVTQDGMQ

SEQ ID NO: 13034 - protein, 64 aa, Homo Sapiens
MGLSFSSGNVSFASRDGDPPCRAKKQMDFHLTNLRDPRSRNNISGFGRRSLNNTTSPTASWLQL

SEQ ID NO: 13035 - protein, 39 aa, Homo Sapiens
MGLSFSSGPRSFFPVGIGEHLQSFTTCQLCDSIKYLLQK

SEQ ID NO: 13036 - protein, 411 aa, Homo Sapiens
MGLSFSSGQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 13037 - protein, 385 aa, Homo Sapiens
MAAFLSAGLGILAPSETYPLPTTSSGWEPRLGSPFPSGPCTSSTGAQAVAEPTGQGPKNPRVSRVTVQLEMKPLWEEFNQLGTEMIVTKAGRRMFPPFQVKILGMDSLADYALLMDFIPLDDKRYRYAFHSSAWLVAGKADPATPGRVHFHPDSPAKGAQWMRQIVSFDKLKLTNNLLDDNGHIILNSMHRYQPRFHVVFVDPRKDSERYAQENFKSFIFTETQFTAVTAYQNHRITQLKIASNPFAKGFRESDLDSWPVAPRPLLSVPARSHSSLSPCVLKGATDREKDPNKASASTSKTPAWLHHQLLPPPEVLLAPATYRPVTYQSLYSGAPSHLGIPRTRPAPYPLPNIRADRDQGGLPLPAGLGLLSPTVVCLGPGQDSQ

SEQ ID NO: 13038 - protein, 446 aa, Homo Sapiens
MGKRYMHHPQIQMISTVNLLVIHLLSHQPVCSLALSLCKSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 13039 - protein, 58 aa, Homo Sapiens
MNPQQQRMAAIGTDKELSDLLDFSAMFSPPVNSGKTRPTTLGSSQFSGSGFYRQPSLQ

SEQ ID NO: 13040 - protein, 157 aa, Homo Sapiens
MNPQQQRMAAIGTDKELSDLLDFSAMFSPPVNSGKTRPTTLGSSQFSGSGIDERGGTTSWGTSGQPSPSYDSSRGFTDSPHYSDHLNDSRLGAHEGLSPTPFMNSNLMGKTSERGSFSLYSRDTGLPGCQSSLLRQDLGLGSPAQLSSSGKPGTAYY

SEQ ID NO: 13041 - protein, 682 aa, Homo Sapiens
MNPQQQRMAAIGTDKELSDLLDFSAMFSPPVNSGKTRPTTLGSSQFSGSGIDERGGTTSWGTSGQPSPSYDSSRGFTDSPHYSDHLNDSRLGAHEGLSPTPFMNSNLMGKTSERGSFSLYSRDTGLPGCQSSLLRQDLGLGSPAQLSSSGKPGTAYYSFSATSSRRRPLHDSAALDPLQAKKVRKVPPGLPSSVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 13042 - protein, 706 aa, Homo Sapiens
MNPQQQRMAAIGTDKELSDLLDFSAMFSPPVNSGKTRPTTLGSSQFSGSGIDERGGTTSWGTSGQPSPSYDSSRGFTDSPHYSDHLNDSRLGAHEGLSPTPFMNSNLMGKTSERGSFSLYSRDTGLPGCQSSLLRQDLGLGSPAQLSSSGKPGTAYYSFSATSSRRRPLHDSAALDPLQAKKVRKVPPGLPSSVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLKNRVEQQLHEHLQDAMSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 13043 - protein, 706 aa, Homo Sapiens; identical to SEQ ID NO: 13042

SEQ ID NO: 13044 - protein, 682 aa, Homo Sapiens; identical to SEQ ID NO: 13041

SEQ ID NO: 13045 - protein, 666 aa, Homo Sapiens
MNPQQQRMAAIGTDKELSDLLDFSAMFSPPVNSGKTRPTTLGSSQFSGSGTIHEMKQLNSKARQKGQRIKGFTDSPHYSDHLNDSRLGAHEGLSPTPFMNSNLMGKTSERGSFSLYSRDTGLPGCQSSLLRQDLGLGSPAQLSSSGKPGTAYYSFSATSSRRRPLHDSAALDPLQAKKVRKVPPGLPSSVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLKNRVEQQLHEHLQDAMSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACL

SEQ ID NO: 13046 - protein, 339 aa, Homo Sapiens
MSSNSSTSQWPRPGGQAPSSPSYENSLHSLKNRVEQQLHEHLQDAMSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 13047 - protein, 316 aa, Homo Sapiens
MSSNSSTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 13048 - protein, 536 aa, Homo Sapiens
MYCAYPVPGMGSNSLMYYYNGKTVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLKNRVEQQLHEHLQDAMSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 13049 - protein, 512 aa, Homo Sapiens
MYCAYPVPGMGSNSLMYYYNGKTVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 13050 - protein, 48 aa, Homo Sapiens
  misc_feature (1)..(1): Xaa can be any naturally occurring amino acid
XERNLNPKAACLKRREEEKVSAVSAEPPTTLPGTHPGLSETTNPMGHM

SEQ ID NO: 13051 - protein, 44 aa, Homo Sapiens
  misc_feature (1)..(1): Xaa can be any naturally occurring amino acid
XNPKAACLKRREEEKVSAVSAEPPTTLPGTHPGLSETTNPMGHM

SEQ ID NO: 13052 - protein, 433 aa, Homo Sapiens
MRQSHQLPLVGLLLFSFIPSQLCEICEVSEENYIRLKPLLNTMIQSNYNRGTSAVNVVLSLKLVGIQIQTLMQKMIQQIKYNVKSRLSDVSSGELALIILALGVCRNAEENLIYDYHLIDKLENKFQAEIENMEAHNGTPLTNYYQLSLDVLALCLFNGNYSTAEVVNHFTPENKNYYFGSQFSVDTGAMAVLALTCVKKSLINGQIKADEGSLKNISIYTKSLVEKILSEKKENGLIGNTFSTGEAMQALFVSSDYYNENDWNCQQTLNTVLTEISQGAFSNPNAAAQVLPALMGKTFLDINKDSSCVSASGNFNISADEPITVTPPDSQSYISVNYSVRINETYFTNVTVLNGSVFLSVMEKAQKMNDTIFGFTMEERSWGPYITCIQGLCANNNDRTYWELLSGGEPLSQGAGSYVVRNGENLEVRWSKY

SEQ ID NO: 13053 - protein, 402 aa, Homo Sapiens
MDSHLVEKLGQHLLPWMDRLSLEHLNPSIYVGLRLSSLQAGTKEDLYLHSLKLGYQQCLLGSAFSEDDGDCQGKPSMGQLALYLLALRANCEFVRGHKGDRLVSQLKWFLEDEKRAIGHDHKGHPHTSYYQYGLGILALCLHQKRVHDSVVDKLLYAVEPFHQGHHSVDTAAMAGLAFTCLKRSNFNPGRRQRITMAIRTVREEILKAQTPEGHFGNVYSTPLALQFLMTSPMRGAELGTACLKARVALLASLQDGAFQNALMISQLLPVLNHKTYIDLIFPDCLAPRVMLEPAAETIPQTQEIISVTLQVLSLLPPYRQSISVLAGSTVEDVLKKAHELGGFTYETQASLSGPYLTSVMGKAAGEREFWQLLRDPNTPLLQGIADYRPKDGETIELRLVSW

SEQ ID NO: 13054 - protein, 423 aa, Homo Sapiens
MRHLGAFLFLLGVLGALTEMCEIPEMDSHLVEKLGQHLLPWMDRLSLEHLNPSIYVGLRLSSLQAGTKEDLYLHSLKLGYQQCLLGEDDGDCQGKPSMGQLALYLLALRANCEFVRGHKGDRLVSQLKWFLEDEKRAIGHDHKGHPHTSYYQYGLGILALCLHQKRVHDSVVDKLLYAVEPFHQGHHSVDTAAMAGLAFTCLKRSNFNPGRRQRITMAIRTVREEILKAQTPEGHFGNVYSTPLALQFLMTSPMRGAELGTACLKARVALLASLQDGAFQNALMISQLLPVLNHKTYIDLIFPDCLAPRVMLEPAAETIPQTQEIISVTLQVLSLLPPYRQSISVLAGSTVEDVLKKAHELGGFTYETQASLSGPYLTSVMGKAAGEREFWQLLRDPNTPLLQGIADYRPKDGETIELRLVSW

SEQ ID NO: 13055 - protein, 427 aa, Homo Sapiens
MRHLGAFLFLLGVLGALTEMCEIPEMDSHLVEKLGQHLLPWMDRLSLEHLNPSIYVGLRLSSLQAGTKEDLYLHSLKLGYQQCLLGSAFSEDDGDCQGKPSMGQLALYLLALRANCEFVRGHKGDRLVSQLKWFLEDEKRAIGHDHKGHPHTSYYQYGLGILALCLHQKRVHDSVVDKLLYAVEPFHQGHHSVDTAAMAGLAFTCLKRSNFNPGRRQRITMAIRTVREEILKAQTPEGHFGNVYSTPLALQFLMTSPMRGAELGTACLKARVALLASLQDGAFQNALMISQLLPVLNHKTYIDLIFPDCLAPRVMLEPAAETIPQTQEIISVTLQVLSLLPPYRQSISVLAGSTVEDVLKKAHELGGFTYETQASLSGPYLTSVMGKAAGEREFWQLLRDPNTPLLQGIADYRPKDGETIELRLVSW

SEQ ID NO: 13056 - protein, 400 aa, Homo Sapiens
MRHLGAFLFLLGVLGALTEMCEIPEMDSHLVEKLGQHLLPWMDRLSLEHLNPSIYVGLRLSSLQAGTKEDLYLHSLKLGYQQCLLGSAFSEDDGDCQGKPSMGQLALYLLALRANWHDHKGHPHTSYYQYGLGILALCLHQKRVHDSVVDKLLYAVEPFHQGHHSVDTAAMAGLAFTCLKRSNFNPGRRQRITMAIRTVREEILKAQTPEGHFGNVYSTPLALQFLMTSPMRGAELGTACLKARVALLASLQDGAFQNALMISQLLPVLNHKTYIDLIFPDCLAPRVMLEPAAETIPQTQEIISVTLQVLSLLPPYRQSISVLAGSTVEDVLKKAHELGGFTYETQASLSGPYLTSVMGKAAGEREFWQLLRDPNTPLLQGIADYRPKDGETIELRLVSW

SEQ ID NO: 13057 - protein, 94 aa, Homo Sapiens
DTDVLQPTLVNAGHFSLCVNVVLETDWSSPVSARSTEGEEPAVGPGLPRLRGPFWKFPGPGHAGLGAHPLHHPVIQQEGFLPAPRGFGYRSEVD

SEQ ID NO: 13058 - protein, 483 aa, Homo Sapiens [sequence omitted]

SEQ ID NO: 13059 - protein, 73 aa, Homo Sapiens
MKGRFLFPLRLLLWMCLHLQRQASELHQPSMPGCPLTSSSRLFDNAQMHQFLNIHVKFENCTFGEIKFYIQLA

SEQ ID NO: 13060 - protein, 88 aa, Homo Sapiens
MRPRGLPPLLVVLLGCWASVSAQTDATPAVTTEGLNSTEAALATFGTFPSTRPPGTPRAPGPSSGPRPTPVTDGATASFVVKKQSSIH

SEQ ID NO: 13061 - protein, 88 aa, Homo Sapiens; identical to SEQ ID NO: 13060

SEQ ID NO: 13062 - protein, 75 aa, Homo Sapiens
MRPRGLPPLLVVLLGCWASVSAQTDATPAVTTEGLNSTEAALATFGTFPSTRPPGTPRAPGPSSGPRPTPVTDGG

SEQ ID NO: 13063 - protein, 100 aa, Homo Sapiens
MRPRGLPPLLVVLLGCWASVSAQTDATPAVTTEGLNSTEAALATFGTFPSTRPPGTPRAPGPSSGPRPTPVTDGGYHVPAPGVHSDPTSRGQPRCCSLCL

SEQ ID NO: 13064 - protein, 100 aa, Homo Sapiens; identical to SEQ ID NO: 13063

SEQ ID NO: 13065 - protein, 100 aa, Homo Sapiens; identical to SEQ ID NO: 13063

SEQ ID NO: 13066 - protein, 106 aa, Homo Sapiens
MRPRGLPPLLVVLLGCWASVSAQTDATPAVTTEGLNSTEAALATFGTFPSTRPPGTPRAPGPSSGPRPTPVTDGHATCRYRSRRLTVSGELDGKLQVASGSVGGEE

SEQ ID NO: 13067 - protein, 83 aa, Homo Sapiens
MRPRGLPPLLVVLLGCWASVSAQTDATPAVTTEGLNSTEAALATFGTFPSTRPPGTPRAPGPSSGPRPTPVTDGSHSVTQAGV

SEQ ID NO: 13068 - protein, 162 aa, Homo Sapiens
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNCRCSV

SEQ ID NO: 13069 - protein, 179 aa, Homo Sapiens
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNSHFTPGLSRWLCESRSRILSFP

SEQ ID NO: 13070 - protein, 245 aa, Homo Sapiens
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEVSLNLIDSFHPITNIFPCKLIFKVTRKTGFLETELIL

SEQ ID NO: 13071 - protein, 592 aa, Homo Sapiens
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKHFVLQDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 13072 - protein, 587 aa, Homo Sapiens
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 13073 - protein, 573 aa, Homo Sapiens
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAGQAYWFTPVIPALWEAEARGSLEVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 13074 - protein, 263 aa, Homo Sapiens
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAGQAYWFTPVIPALWEAEARGSLERFW

SEQ ID NO: 13075 - protein, 573 aa, Homo Sapiens [sequence omitted]

SEQ ID NO: 13076 - protein, 625 aa, Homo Sapiens
MRLETAEAYVGPGGPECPMRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 13077 - protein, 459 aa, Homo Sapiens
MRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNCFLESKSTTCTRFFKNLASSCTLDSALNAASYYNFTVLKVPRSMTDPQNMEAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 13078 - protein, 443 aa, Homo Sapiens
MRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSVSFLELGGLLQPNEKSCKGFQTYVRLAKGEEFFVHYNEVLIY

SEQ ID NO: 13079 - protein, 607 aa, Homo Sapiens
MRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 13080 - protein, 607 aa, Homo Sapiens; identical to SEQ ID NO: 13079

SEQ ID NO: 13081 - protein, 304 aa, Homo Sapiens
MATWKSPCFLYCLFILGPRLTGQNNSVDLTNEETTDSTTSKISPSEDTQQENGSMFSLITWNIDGLDLNNLSERARGVCSYLALYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREVTRCGGLPNNIVDVWEFLGKPKHCQYTWDTQMNSNLGITAACKLRFDRIFFRAAAEEGHIIPRSLDLLGLEKLDCGRFPSDHWGLLCNLDIIL

SEQ ID NO: 13082 - protein, 362 aa, Homo Sapiens
MELGSCLEGGREAAEEEGEPEVKKRRLLCVEFASVASCDAAVAQCFLAENDWEMERALNSYFEPPVEESALERRPETISEPKTYVDLTNEETTDSTTSKISPSEDTQQENGSMFSLITWNIDGLDLNNLSERARGVCSYLALYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREVTRCGGLPNNIVDVWEFLGKPKHCQYTWDTQMNSNLGITAACKLRFDRIFFRAAAEEGHIIPRSLDLLGLEKLDCGRFPSDHWGLLCNLDIIL

SEQ ID NO: 13083 - protein, 426 aa, Homo Sapiens
MGRRRQRVDPAAGARAGALPEAIAALSRSLPSGPSPEIFRRAKFDRPEATSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 13084 - protein, 495 aa, Homo Sapiens
MGRRRQRVDPAAGARAGALPEAIAALSRSLPSGPSPEIFRRAKFDRPEATSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQVSGAGAAQNLDLAYPKCLHSFCTPGMGPRTFWNDLWLVCEQPGLLPGDWAAPLDPGGASACSLLSPFRALLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 13085 - protein, 393 aa, Homo Sapiens
MGRRRQRVDPAAGARAGALPEAIAALSRSLPSGPSPEIFRRAKFDRPEATSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 13086 - protein, 119 aa, Homo Sapiens
MGRRRQRVDPAAGARAGALPEAIAALSRSLPSGPSPEIFRRAKFDRPEATSALWQLLFRVLSPLPAGNALATRGWHWHNYLRMARRAVGSCCWLCPGSWPEDLCPSRCWPRPECLWVTR

SEQ ID NO: 13087 - protein, 54 aa, Homo Sapiens
MLAQARVPLGDEMTVCQCEALASPGPPAPHMEAEGPVDVRHVQWLMGKLRFRWR

SEQ ID NO: 13088 - protein, 157 aa, Homo Sapiens
MLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQLLRTLERENQRLEAVLAWRRSELVFWRWMDTVLGTCAPEVPAAASQPTFLPWVPE

SEQ ID NO: 13089 - protein, 248 aa, Homo Sapiens
MLAQARVPLGDEMTVCQIHLYTRGCHSDQSLSHLSVTEAEMLRDPEGGQQLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 13090 - protein, 248 aa, Homo Sapiens; identical to SEQ ID NO: 13089

SEQ ID NO: 13091 - protein, 80 aa, Homo Sapiens
MSGQRGDWTSALWQLLFRVLSPLPAGNALASLALEVQARLVKSALCSQGYPRLALAQLPEDGSQGSRELLLALSWLLARG

SEQ ID NO: 13092 - protein, 110 aa, Homo Sapiens
MSGQRGDWTSALWQLLFRVLSPLPAGNALASLALEVQARLVKSALCSQGYPRLALAQLPEDGSQGSRELLLALSWLLARGPVPEQMLAQARVPLGDEMTVCQCEALASPG

SEQ ID NO: 13093 - protein, 216 aa, Homo Sapiens
MSGQRGDWTSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQLLRTLERENQRLEAVLAWRRSELVFWRWM

SEQ ID NO: 13094 - protein, 303 aa, Homo Sapiens [sequence omitted]

SEQ ID NO: 13095 - protein, 352 aa, Homo Sapiens
MSGQRGDWTSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 13096 - protein, 354 aa, Homo Sapiens
MSGQRGDWVQTSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 13097 - protein, 976 aa, Homo Sapiens
MDSLASLVLCGVSLLLSASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 13098 - protein, 1124 aa, Homo Sapiens
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 13099 - protein, 1081 aa, Homo Sapiens
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 13100 - protein, 468 aa, Homo Sapiens
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVSMEKQRLTKANSDK

SEQ ID NO: 13101 - protein, 468 aa, Homo Sapiens
MDSLASLVLCGVSLLLSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVIS

SEQ ID NO: 13102 - protein, 298 aa, Homo Sapiens
MGIVCAQCSFILLLSIIRARPPPFLFCPLSSQRTESPYKPVHLGLGPTDKVAAIAMARIIDLVPWDDGSTHVYASPAILLPMERQRNQLAGVKQQLYHPALPTLRHMDRDTVKACLPDEHCQSTTYCRKDEFDNAHFTLLGVPNKPLQCLDITATGQKLRNRYHEGKLAPIAPGINRVDWPCFTRAIEDWSHFVSSAGEFKLPCLRKRAEGLSGYAVRYLKPDVTQTWRQEALCGAWAGRPCSPDSPRPYPCCPPQYCLSQNPSLDRYGQKPLPFDSLNTFRSFGSSYSRVNYLTPWH

SEQ ID NO: 13103 - protein, 271 aa, Homo Sapiens
MGIVCAQCSFILLLSIIRARPPPFLFCPLSSQRTESPYKPVHLGLGPTDKVAAIAMARIIDLVPWDDGSTHVYASPAILLPMERQRNQLAGVKQQLYHPALPTLRHMDRDTVKACLPDEHCQSTTYCRKDEFDNAHFTLLGVPNKPLQCLDITATGQKLRNRYHEGKLAPIAPGINRVDWPCFTRAIEDWSHFVSSAGEFKLPCLRKRAEGLSGYAVRYLKPDVTQTWRYCLSQNPSLDRYGQKPLPFDSLNTFRSFGSSYSRVNYLTPWH

SEQ ID NO: 13104 - protein, 267 aa, Homo Sapiens
MGARQIQTSSSQTSPEEAMGTPRIQHLLILLVLGASLLTSGLELYCQKGLSMTVEADPANMFNWTTEEVETCDKGALCQETILIIKAGTETAILATKGCIPEGEEAITIVQHSSPPGLIVTSYSNYCEDSFCNDKDSLSQFWEFSETTASTVSTTLHCPTCVALGTCFSAPSLPCPNGTTRCYQGKLEITGGGIESSVEVKGCTAMIGCRLMSGILAVGPMFVREACPHQLLTQPRKTENGATCLPIPVWGLQLLLPLLLPSFIHFS

SEQ ID NO: 13105 - protein, 249 aa, Homo Sapiens
MGTPRIQHLLILLVLGASLLTSGLELYCQKGLSMTVEADPANMFNWTTEEVETCDKGALCQETILIIKAGTETAILATKGCIPEGEEAITIVQHSSPPGLIVTSYSNYCEDSFCNDKDSLSQFWEFSETTASTVSTTLHCPTCVALGTCFSAPSLPCPNGTTRCYQGKLEITGGGIESSVEVKGCTAMIGCRLMSGILAVGPMFVREACPHQLLTQPRKTENGATCLPIPVWGLQLLLPLLLPSFIHFS

SEQ ID NO: 13106 - protein, 239 aa, Homo Sapiens
MSDLLLLGLIGGLTLLLLLTLLAFAGYSGLLAGVEVSAGSPPIRNVTVAYKFHMGLYGETGRLFTESCSISPKLRSIAVYYDNPHMERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 13107 - protein, 104 aa, Homo Sapiens
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGE

SEQ ID NO: 13108 - protein, 140 aa, Homo Sapiens
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTT

SEQ ID NO: 13109 - protein, 151 aa, Homo Sapiens
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRV

SEQ ID NO: 13110 - protein, 216 aa, Homo Sapiens
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGT

SEQ ID NO: 13111 - protein, 217 aa, Homo Sapiens
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTG

SEQ ID NO: 13112 - protein, 313 aa, Homo Sapiens
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 13113 - protein, 313 aa, Homo Sapiens; identical to SEQ ID NO: 13112

SEQ ID NO: 13114 - protein, 313 aa, Homo Sapiens; identical to SEQ ID NO: 13112

SEQ ID NO: 13115 - protein, 313 aa, Homo Sapiens; identical to SEQ ID NO: 13112

SEQ ID NO: 13116 - protein, 313 aa, Homo Sapiens; identical to SEQ ID NO: 13112

SEQ ID NO: 13117 - protein, 313 aa, Homo Sapiens; identical to SEQ ID NO: 13112

SEQ ID NO: 13118 - protein, 121 aa, Homo Sapiens
MSLHGILASAGTIGAVAAWLMSYKPALFGFLFLLLLLSNWLVKYEHKLTLPEPQQDEILQRLLFSEMKMKVLENQMFIIWNKMNHHGRSSRHRNFPMKKHRMRRHESICPTLSDCTSSSPS

SEQ ID NO: 13119 - protein, 121 aa, Homo Sapiens
RSLHGILASAGTIGAVAAWLMSYKPALFGFLFLLLLLSNWLVKYEHKLTLPEPQQDEILQRLLFSEMKMKVLENQMFIIWNKMNHHGRSSRHRNFPMKKHRMRRHESICPTLSDCTSSSPS

SEQ ID NO: 13120 - protein, 147 aa, Homo Sapiens
  misc_feature (1)..(1): Xaa can be any naturally occurring amino acid
XSAGTIGAVAAWLMSYKPALFGFLFLLLLLSNWLVKYEHKLTLPEPQQEEEKPKTSENDSKNSKAVNTKEVNRTHACFALQDEILQRLLFSEMKMKVLENQMFIIWNKMNHHGRSSRHRNFPMKKHRMRRHESICPTLSDCTSSSPS

SEQ ID NO: 13121 - protein, 76 aa, Homo Sapiens
MKSVIPSDGPSVACVKKASYLDCIRAIAANEADAVTLDAGLVYDAYLAPNNLKPVVAEFYGSKEDPQTFYYAVAVV

SEQ ID NO: 13122 - protein, 134 aa, Homo Sapiens
MNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCH

SEQ ID NO: 13123 - protein, 102 aa, Homo Sapiens
MRLAVGALLVCAVLGLCLAVPDKTVRWCAVSEHEATKCQSFRDHMKSVIPSDGPFSYRRGPKYGRQGGLDLGASQPGPGTFWQRQIKRIPTIQLSSWEGPAV

SEQ ID NO: 13124 - protein, 120 aa, Homo Sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDFLLCCCCGEEG

SEQ ID NO: 13125 - protein, 698 aa, Homo Sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAIAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 13126 - protein, 115 aa, Homo Sapiens
MRLAVGALLVCAVLGLCLAVPDKTVRWCAVSEHEATKCQSFRDHMKSVIPSDGPSVACVKKASYLDCIRAIAVSRCCLKESGRKPYFLCFQSLWNNSLLTGKRSGCCDTGCRFGV

SEQ ID NO: 13127 - protein, 143 aa, Homo Sapiens
  misc_feature (1)..(1): Xaa can be any naturally occurring amino acid
XYFAIAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGETIQKRRGKGAEMGYRPVSHRKKP

SEQ ID NO: 13128 - protein, 214 aa, Homo Sapiens
MAFLRSMWGVLSALGRSGAELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKEKLKTVKENWKNLSDSEKELYIQHAKEDETRYHNEMKSWEEQMIEVGRKDLLRRTIKKQRKYGAEEC

SEQ ID NO: 13129 - protein, 246 aa, Homo Sapiens
MAFLRSMWGVLSALGRSGAELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQEKLKTVKENWKNLSDSEKELYIQHAKEDETRYHNEMKSWEEQMIEVGRKDLLRRTIKKQRKYGAEEC

SEQ ID NO: 13130 - protein, 219 aa, Homo Sapiens
  misc_feature (1)..(1): Xaa can be any naturally occurring amino acid
XELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQEKLKTVKENWKNLSDSEKEVSITVVSLKCLLRISVRECIRARLDSCEDNLVLLIIQVF

SEQ ID NO: 13131 - protein, 84 aa, Homo Sapiens
MATMENKVICALVLVSMLALGTLAEAQTETCTVAPRERQNCGFPGVTPSQCANKGCCFDDTVRGVPWCFYPNTIDVPPEEECEF

SEQ ID NO: 13132 - protein, 129 aa, Homo Sapiens
MGRRDAQLLAALLVLGLCALAGSEKPSPCQCSRLSPHNRTNCGFPGITSDQCFDNGCCFDSSVTGVPWCFHPLPKQESDQCVMEVSDRRNCGYPGISPEECASRKCCFSNFIFEVPWCFFPKSVEDCHY

SEQ ID NO: 13133 - protein, 94 aa, Homo Sapiens
MKRVLSCVPEPTVVMAARALCMLGLVLALLSSSSAEEYVGLSANQCAVPAKDRVDCGYPHVTPKECNNRGCCFDSRIPGVPWCFKPLQEAECTF

SEQ ID NO: 13134 - protein, 74 aa, Homo Sapiens [sequence omitted]

SEQ ID NO: 13135 - protein, 125 aa, Homo Sapiens
  misc_feature (1)..(1): Xaa can be any naturally occurring amino acid
XALLSSSSAEEYVGLSQQGLWQLTGLCLGQLQTSVPCQPRTGWTAATPMSPPRSATTGAAALTPGSLECLGVSSPCRKQNAPSEAPPAAPGRGMRGSEHPCPAVIAARHCSSQLFCPFAPGKRFC

SEQ ID NO: 13136 - protein, 61 aa, Homo Sapiens
MIYTMKKVHALWASVCLLLNLAPAPLNADSEEDEEHTIITDTELPPLKLMHSFCAFKADDG

SEQ ID NO: 13137 - protein, 76 aa, Homo Sapiens
MIYTMKKVHALWASVCLLLNLAPAPLNADSEEDEEHTIITDTELPPLKLMHSFCAFKADDGPCKAIMKRFFFNIFT

SEQ ID NO: 13138 - protein, 105 aa, Homo Sapiens
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCT

SEQ ID NO: 13139 - protein, 106 aa, Homo Sapiens
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTR

SEQ ID NO: 13140 - protein, 106 aa, Homo Sapiens; identical to SEQ ID NO: 13139

SEQ ID NO: 13141 - protein, 304 aa, Homo Sapiens
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRKKQRVKIAYEEIFVKNM

SEQ ID NO: 13142 - protein, 304 aa, Homo Sapiens; identical to SEQ ID NO: 13141

SEQ ID NO: 13143 - protein, 251 aa, Homo Sapiens
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFVTKEGTNDGWKNAAHIYQVFLNAFCIHASMFFLGLDSISCLC

SEQ ID NO: 13144 - protein, 251 aa, Homo Sapiens; identical to SEQ ID NO: 13143

SEQ ID NO: 13145 - protein, 215 aa, Homo Sapiens
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTREKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRA

SEQ ID NO: 13146 - protein, 107 aa, Homo Sapiens
EACDDACWRIEKVPKVCRLQVSVDDQCEGSTEKYFFNLSSMTCEKFFSGGCHRNRIENRFPDEATCMGFCAPKKNTEPVMLSPILAVEGMTITLLAGRIANVHVQKL

SEQ ID NO: 13147 - protein, 235 aa, Homo Sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKALKKKKKMPKLRFASRIRKIRKKQF

SEQ ID NO: 13148 - protein, 59 aa, Homo Sapiens
MALVLEIFTLLASICWVSANIFEYQVDAQPLRPCELQRETAFLKQADYVPQCAEDGSFQ

SEQ ID NO: 13149 - protein, 2768 aa, Homo Sapiens
MALVLEIFTLLASICWVSANIFEYQVDAQPLRPCELQRETAFLKQADYVPQCAEDGSFQTVQCQNDGRSCWCVGANGSEVLGSRQPGRPVACLSFCQLQKQQILLSGYINSTDTSYLPQCQDSGDYAPVQCDVQQVQCWCVDAEGMEVYGTRQLGRPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 13150 - protein, 901 aa, Homo Sapiens
MLPGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPMSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 13151 - protein, 172 aa, Homo Sapiens
SDARVEAAATWYYSLEHSTDDYASFSRALENATRDYFIICPIIDMASAWAKRARGNVFMYHAPENYGHGRNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 13152 - protein, 74 aa, Homo Sapiens
  misc_feature (1)..(1): Xaa can be any naturally occurring amino acid
XGIQMCSEENGGAWRILDCGSPDIEVHTYPFGWYQKPIAQNNAPSFCPLVVLPSLTEKVFKVREVRGTQLKRME

SEQ ID NO: 13153 - protein, 226 aa, Homo Sapiens
  misc_feature (1)..(1): Xaa can be any naturally occurring amino acid
XGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQSCRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQ

SEQ ID NO: 13154 - protein, 194 aa, Homo Sapiens
  misc_feature (1)..(1): Xaa can be any naturally occurring amino acid
XHSECQWREHSLRPLPFLTPFSSLSQQESLCSAMRHLYLLCPFPPMAGCWAGPRPSRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLT

SEQ ID NO: 13155 - protein, 1224 aa, Homo Sapiens
  misc_feature (1)..(1): Xaa can be any naturally occurring amino acid
XQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 13156 - protein, 147 aa, Homo Sapiens
  misc_feature (1)..(1): Xaa can be any naturally occurring amino acid
XSAGASALLRSGPYMPQCDAFGSWEPVQCHAGTGHCWCVDEKGGFIPGSLTARSLQIPQCPTTCEKSRTSGLLSSWKQARSQENPSPKDLFVPACLEARGVRCHSTRRRWLVEQSCVRQSRAPQALPCSSANCCAARAPGACFHQGH

SEQ ID NO: 13157 - protein, 62 aa, Homo Sapiens
  misc_feature (1)..(1): Xaa can be any naturally occurring amino acid
XSDMGSRPESMGCRKDTVPRPASPTEAGCVQEHSFCQLAEITESASLYFTCTLYPEAQVCDD

SEQ ID NO: 13158 - protein, 390 aa, Homo Sapiens
MPPSGLRLLPLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 13159 - protein, 120 aa, Homo Sapiens
  misc_feature (1)..(1): Xaa can be any naturally occurring amino acid
XFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKLNEQNLIQEVPNIWQREVG

SEQ ID NO: 13160 - protein, 414 aa, Homo Sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 13161 - protein, 442 aa, Homo Sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSETVCPVVTTPSGSVGSLCSRQSQVLCGYLDAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 13162 - protein, 412 aa, Homo Sapiens
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 13163 - protein, 309 aa, Homo Sapiens
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFR

SEQ ID NO: 13164 - protein, 683 aa, Homo Sapiens
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPANRPQERGDELADSALEIFKQASAFSRASQRSVRLAPVYQKLLERMKH

SEQ ID NO: 13165 - protein, 65 aa, Homo Sapiens
MATNGVVHVITNVLQPPANRPQERGDELADSALEIFKQASAFSRASQRSVRLAPVYQKLLERMKH

SEQ ID NO: 13166 - protein, 219 aa, Homo Sapiens
RAAVAASGLNTMLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNVSSGS

SEQ ID NO: 13167 - protein, 366 aa, Homo Sapiens
  misc_feature (1)..(1): Xaa can be any naturally occurring amino acid
XAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPAPVYQKLLERMKH

SEQ ID NO: 13168 - protein, 59 aa, Homo Sapiens
  misc_feature (1)..(1): Xaa can be any naturally occurring amino acid
XKTLFELAAESDVSTAIDLFRQAGLGNHLSGSERLTLLAPLNSVFKGAHLSGPNHHPFL

SEQ ID NO: 13169 - protein, 194 aa, Homo Sapiens
  misc_feature (1)..(1): Xaa can be any naturally occurring amino acid
XNGVVHLIDKVISTITNNIQQIIEIEDTFETLRAAVAASGLNTMLEGNGQYTLLAPTNEAFEKIPSETLNRILGDPEALRDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTL

SEQ ID NO: 13170 - protein, 128 aa, Homo Sapiens
  misc_feature (1)..(1): Xaa can be any naturally occurring amino acid
XPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAVR

SEQ ID NO: 13171 - protein, 78 aa, Homo Sapiens
  misc_feature (1)..(1): Xaa can be any naturally occurring amino acid
XQGDKLEVSLKNNVVSVNKEPVAEPDIMATNGVVHVITNVLQPPANRPQERGDELADSALEIFKQASAFSRPLSIKSY

SEQ ID NO: 13172 - protein, 114 aa, Homo Sapiens
MCIAEIDLIPRDRPFVCAPSSKTGSVTTTYCCNQDHCNKIELPTTGLPLLVQRTIARTIVLQESIGKGRFGEVWRGKWRGEEVAVKIFSSREERSWFREAEIYQTVMLRHENIL

SEQ ID NO: 13173 - protein, 114 aa, Homo Sapiens
MCIAEIDLIPRDRPFVCAPSSKTGSVTTTYCCNQDHCNKIELPTTGPFSVKSSPGLGPVELAAVIAGPVCFVCISLMLMVYICHNRTVIHHRVPNEEDPSLDRPFISEGTTLKD

SEQ ID NO: 13174 - protein, 126 aa, Homo Sapiens
MCIAEIDLIPRDRPFVCAPSSKTGSVTTTYCCNQDHCNKIELPTTGPFSVKSSPGLGPVELAAVIAGPVCFVCISLMLMVYICHNRTVIHHRVPNEEDPSLDRPFISEGTTLKDLIYDMTTSGSGS

SEQ ID NO: 13175 - protein, 118 aa, Homo Sapiens
MCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTS

SEQ ID NO: 13176 - protein, 122 aa, Homo Sapiens
MCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGS

SEQ ID NO: 13177 - protein, 434 aa, Homo Sapiens
MCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 13178 - protein, 426 aa, Homo Sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 13179 - protein, 383 aa, Homo Sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTGPFSVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRNS

SEQ ID NO: 13180 - protein, 507 aa, Homo Sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTGPFSVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 13181 - protein, 503 aa, Homo Sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 13182 - protein, 35 aa, Homo Sapiens
MTSHYVIAIFALMSSCLATAGPEPGALCELSPVSA

SEQ ID NO: 13183 - protein, 89 aa, Homo Sapiens
MTSHYVIAIFALMSSCLATAGPEPGALCELSPVSASHPVQALMESFTVLSGCASRGTTGLPQEVHVLNLRTAGQGPGQLQREACSMNHY

SEQ ID NO: 13184 - protein, 851 aa, Homo Sapiens
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 13185 - protein, 850 aa, Homo Sapiens
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 13186 - protein, 850 aa, Homo Sapiens; identical to SEQ ID NO: 13185

SEQ ID NO: 13187 - protein, 851 aa, Homo Sapiens; identical to SEQ ID NO: 13184

SEQ ID NO: 13188 - protein, 49 aa, Homo Sapiens
MTSHYVIAIFALMSSCLATAGWSAMARSWLTATSASRVQAILLPQPPEY

SEQ ID NO: 13189 - protein, 94 aa, Homo Sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASL

SEQ ID NO: 13190 - protein, 1170 aa, Homo Sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 13191 - protein, 83 aa, Homo Sapiens
MVWRLVLLALWVWPSTQAGHQDKDTTFDLFSISNINRKTIGAKQFRGPDPGVPAYRFVRFDYIPPVNADDLSKITKIMRQKEG

SEQ ID NO: 13192 - protein, 1172 aa, Homo Sapiens
MVWRLVLLALWVWPSTQAGHQDKDTTFDLFSISNINRKTIGAKQFRGPDPGVPAYRFVRFDYIPPVNADDLSKITKIMRQKEGFFLTAQLKQDGKSRGTLLALEGPGLSQRQFEIVSNGPADTLDLTYWIDGTRHVVSLEDVGLADSQWKNVTVQVAGETYSLHVGCDLIDSFALDEPFYEHLQAEKSRMYVAKGSARESHFRGLLQNVHLVFENSVEDILSKKGCQQGQGAEINAISENTETLRLGPHVTTEYVGPSSERRPEVCERSCEELGNMVQELSGLHVLVNQLSENLKRVSNDNQFLWELIGGPPKTRNMSACWQDGRFFAENETWVVDSCTTCTCKKFKTICHQITCPPATCASPSFVEGECCPSCLHSVDGEEGWSPWAEWTQCSVTCGSGTQQRGRSCDVTSNTCLGPSIQTRACSLSKCDTRIRQDGGWSHWSPWSSCSVTCGVGNITRIRLCNSPVPQMGGKNCKGSGRETKACQGAPCPIDGRWSPWSPWSACTVTCAGGIRERTRVCNSPEPQYGGKACVGDVQERQMCNKRSCPVDGCLSNPCFPGAQCSSFPDGSWSCGSCPVGFLGNGTHCEDLDECALVPDICFSTSKVPRCVNTQPGFHCLPCPPRYRGNQPVGVGLEAAKTEKQVCEPENPCKDKTHNCHKHAECIYLGHFSDPMYKCECQTGYAGDGLICGEDSDLDGWPNLNLVCATNATYHCIKDNCPHLPNSGQEDFDKDGIGDACDDDDDNDGVTDEKDNCQLLFNPRQADYDKDEVGDRCDNCPYVHNPAQIDTDNNGEGDACSVDIDGDDVFNERDNCPYVYNTDQRDTDGDGVGDHCDNCPLVHNPDQTDVDNDLVGDQCDNNEDIDDDGHQNNQDNCPYISNANQADHDRDGQGDACDPDDDNDGVPDDRDNCRLVFNPDQEDLDGDGRGDICKDDFDNDNIPDIDDVCPENNAISETDFRNFQMVPLDPKGTTQIDPNWVIRHQGKELVQTANSDPGIAVGFDEFGSVDFSGTFYVNTDRDDDYAGFVFGYQSSSRFYVVMWKQVTQTYWEDQPTRAYGYSGVSLKVVNSTTGTGEHLRNALWHTGNTPGQVRTLWHDPRNIGWKDYTAYRWHLTHRPKTGYIRVLVHEGKQVMADSGPIYDQTYAGGRLGLFVFSQEMVYFSDLKYECRDI

SEQ ID NO: 13193 - protein, 1172 aa, Homo Sapiens; identical to SEQ ID NO: 13192

SEQ ID NO: 13194 - protein, 485 aa, Homo Sapiens
MDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 13195 - protein, 947 aa, Homo Sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 13196 - protein, 956 aa, Homo Sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 13197 - protein, 400 aa, Homo Sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVTNALHSILGEGNVPDPKHHYGVSGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEASPMDWTIALKSPTHYRQTGMRTGWEMLATAALK

SEQ ID NO: 13198 - protein, 836 aa, Homo Sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 13199 - protein, 870 aa, Homo Sapiens
MGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVKETSFLRNTIAECQACGPLKFQSPTPSTVVPPAPPAPPTRPPRRCDSNPCFRGVQCTDSRDGFQCGPCPEGYTGNGITCIDVDECKYHPCYPGVHCINLSPGFRCDACPVGFTGPMVQGVGISFAKSNKQVCTDIDECRNGACVPNSICVNTLGSYRCGPCKPGYTGDQIRGCKAERNCRNPELNPCSVNAQCIEERQGDVTCVCGVGWAGDGYICGKDVDIDSYPDEELPCSARNCKKDNCKYVPNSGQEDADRDGIGDACDEDADGDGILNEQDNCVLIHNVDQRNSDKDIFGDACDNCLSVLNNDQKDTDGDGRGDACDDDMDGDGIKNILDNCPKFPNRDQRDKDGDGVGDACDSCPDVSNPNQSDVDNDLVGDSCDTNQDSDGDGHQDSTDNCPTVINSAQLDTDKDGIGDECDDDDDNDGIPDLVPPGPDNCRLVPNPAQEDSNSDGVGDICESDFDQDQVIDRIDVCPENAEVTLTDFRAYQTVVLDPEGDAQIDPNWVVLNQGMEIVQTMNSDPGLAVGYTAFNGVDFEGTFHVNTQTDDDYAGFIFGYQDSSSFYVVMWKQTEQTYWQATPFRAVAEPGIQLKAVKSKTGPGEHLRNSLWHTGDTSDQVRLLWKDSRNVGWKDKVSYRWFLQHRPQVGYIRVRFYEGSELVADSGVTIDTTMRGGRLGVFCFSQENIIWSNLKYRCNDTIPEDFQEFQTQNFDRFDN

SEQ ID NO: 13200 - protein, 961 aa, Homo Sapiens
MLAPRGAAVLLLHLVLQRWLAAGAQATPQVFDLLPSSSQRLNPGALLPVLTDPALNDLYVISTFKLQTKSSATIFGLYSSTDNSKYFEFTVMGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVKETSFLRNTIAECQACGPLKFQSPTPSTVVPPAPPAPPTRPPRRCDSNPCFRGVQCTDSRDGFQCGPCPEGYTGNGITCIDVDECKYHPCYPGVHCINLSPGFRCDACPVGFTGPMVQGVGISFAKSNKQVCTDIDECRNGACVPNSICVNTLGSYRCGPCKPGYTGDQIRGCKAERNCRNPELNPCSVNAQCIEERQGDVTCVCGVGWAGDGYICGKDVDIDSYPDEELPCSARNCKKDNCKYVPNSGQEDADRDGIGDACDEDADGDGILNEQDNCVLIHNVDQRNSDKDIFGDACDNCLSVLNNDQKDTDGDGRGDACDDDMDGDGIKNILDNCPKFPNRDQRDKDGDGVGDACDSCPDVSNPNQSDVDNDLVGDSCDTNQDSDGDGHQDSTDNCPTVINSAQLDTDKDGIGDECDDDDDNDGIPDLVPPGPDNCRLVPNPAQEDSNSDGVGDICESDFDQDQVIDRIDVCPENAEVTLTDFRAYQTVVLDPEGDAQIDPNWVVLNQGMEIVQTMNSDPGLAVGYTAFNGVDFEGTFHVNTQTDDDYAGFIFGYQDSSSFYVVMWKQTEQTYWQATPFRAVAEPGIQLKAVKSKTGPGEHLRNSLWHTGDTSDQVRLLWKDSRNVGWKDKVSYRWFLQHRPQVGYIRVRFYEGSELVADSGVTIDTTMRGGRLGVFCFSQENIIWSNLKYRCNDTIPEDFQEFQTQNFDRFDN

SEQ ID NO: 13201 - protein, 57 aa, Homo Sapiens
HDGKMLASASEDHFIDIAEVETVQQTHSASQKAAGPLAKRPVCSIVIIPPSLLPFES

SEQ ID NO: 13202 - protein, 105 aa, Homo Sapiens
MAVPAAAMGPSALGQSGPGSMAPWCSVSSGPSRYVLGMQELFRGHSKTREFLAHSAKVHSVAWSCDGRRLASGSFDKTASVFLLEKDRLGRTLISAGVLMGRPLL

SEQ ID NO: 13203 - protein, 105 aa, Homo Sapiens; identical to SEQ ID NO: 13202

SEQ ID NO: 13204 - protein, 351 aa, Homo Sapiens
MAVPAAAMGPSALGQSGPGSMAPWCSVSSGPSRYVLGMQELFRGHSKTREFLAHSAKVHSVAWSCDGRRLASGSFDKTASVFLLEKDRLVKENNYRGHGDSVDQLCWHPSNPDLFVTASGDKTIRIWDVRTTKCIATVNTKGENINICWSPDGQTIAVGNKDDVVTFIDAKTHRSKAEEQFKFEVNEISWNNDNNMFFLTNGNGCINILSYPELKPVQSINAHPSNCICIKFDPMGKYFATGSADALVSLWDVDELVCVRCFSRLDWPVRTLSFSHDGKMLASASEDHFIDIAEVETGDKLWEVQCESPTFTVAWHPKRPLLAFACDDKDGKYDSSREAGTVKLFGLPNDS

SEQ ID NO: 13205 - protein, 327 aa, Homo Sapiens
MAVPAAAMGPSALGQSGPGSMAPWCSVSSGPSRYVLGMQELFRGHSKTREFLAHSAKVHSVAWSCDGRRLASGSFDKTASVFLLEKDRLVKENNYRGHGDSVDQLCWHPSNPDLFVTASGDKTIRIWDVRTTKCIATVNTKGENINICWSPDGQTIAVGNKDDVVTFIDAKTHRSKAEEQFKFEVNEISWNNDNNMFFLTNGNGCINILSYPELKPVQSINAHPSNCICIKFDPMGKYFATGSADALVSLWDVDELVCVRCFSRLDWPVRTLSFSHDGKMLASASEDHFIDIAEVETGNFMRIYRLSPLAVRTSLVISSLHVTTSPA

SEQ ID NO: 13206 - protein, 166 aa, Homo Sapiens
MAWLCGSLPVVVAVTAMETAARQECYPELKPVQSINAHPSNCICIKFDPMGKYFATGSADALVSLWDVDELVCVRCFSRLDWPVRTLSFSHDGKMLASASEDHFIDIAEVETGDKLWEVQCESPTFTVAWHPKRPLLAFACDDKDGKYDSSREAGTVKLFGLPNDS

SEQ ID NO: 13207 - protein, 13 aa, Homo Sapiens
VAVTAMETAARQE

SEQ ID NO: 13208 - protein, 55 aa, Homo Sapiens
VVVAVTAMETAARQEWSKKTIIGDMGIVWTSFVGIQVILTYLLRRPEIKPFASGM

SEQ ID NO: 13209 - protein, 56 aa, Homo Sapiens
  misc_feature (1)..(1): Xaa can be any naturally occurring amino acid
XQSINAHPSNCICIKFDPMGKYFATGSADALVSLWDVDELVCVRCFSRGQTMGGTV

SEQ ID NO: 13210 - protein, 75 aa, Homo Sapiens
  misc_feature (1)..(1): Xaa can be any naturally occurring amino acid
XVSLWDVDELVCVRCFSRLDWPVRTLSFSHDGKMLASASEDHFIDIAEVETDRVSFCHPAWCAVVQAILLPQPPK

SEQ ID NO: 13211 - protein, 349 aa, Homo Sapiens
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQGRTTAHKDPNAIFLSFQHLLRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 13212 - protein, 286 aa, Homo Sapiens
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKDFWIVGDKLHCLSQNYWLWASEVAAGIQSQDSWSAEPNLQVPGPNPRIPEQDTRTLEWNSWTLSWTLTQDPRSPGHFLRNIRHRLPATQPPAWIFSFPNPSSYWTVYALPSSTHLAHPCGPAPPPAS

SEQ ID NO: 13213 - protein, 353 aa, Homo Sapiens
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 13214 - protein, 353 aa, Homo Sapiens; identical to SEQ ID NO: 13213

SEQ ID NO: 13215 - protein, 353 aa, Homo Sapiens; identical to SEQ ID NO: 13213

SEQ ID NO: 13216 - protein, 12 aa, Homo Sapiens
  misc_feature (1)..(1): Xaa can be any naturally occurring amino acid
XQSLLGTQTREA

SEQ ID NO: 13217 - protein, 219 aa, Homo Sapiens
MFVSYLILTLLHVQTAVLARPGGESIGCDDYLGSDKVVDKCGVCGGDNTGCQVVSGVFKHALTSLGYHRVVEIPEGATKINITEMYKSNKKKSHLKPATRGSQFSSVKVCSVPAACKLLGTPGRARQPVPAPRELEHDKNSPHCAYLSLYLTSLAQSSWRVFSLFSYVLIYLFSKYLAFNTLFALKRMALQRDRKEKTRAWCIFIKLCGREIQILPGPV

SEQ ID NO: 13218 - protein, 658 aa, Homo Sapiens
MFVSYLILTLLHVQTAVLARPGGESIGCDDYLGSDKVVDKCGVCGGDNTGCQVVSGVFKHALTSLGYHRVVEIPEGATKINITEMYKSNNYLALRSRSGRSIINGNWAIDRPGKYEGGGTMFTYKRPNEISSTAGESFLAEGPTNEILDVYMIHQQPNPGVHYEYVIMGTNAISPQVPPHRRPGEPFNGQMVTEGRSQEEGEQKGRNEEKEDLRGEAPEMFTSESAQTFPVRHPDRFSPHRPDNLVPPAPQPPRRSRDHNWKQLGTTECSTTCGKGSQYPIFRCVHRSTHEEAPESYCDSSMKPTPEEEPCNIFPCPAFWDIGEWSECSKTCGLGMQHRQVLCRQVYANRSLTVQPYRCQHLEKPETTSTCQLKICSEWQIRTDWTSCSVPCGVGQRTRDVKCVSNIGDVVDDEECNMKLRPNDIENCDMGPCAKSWFLTEWSERCSAECGAGVRTRSVVCMTNHVSSLPLEGCGNNRPAEATPCDNGPCTGKVEWFAGSWSQCSIECGSGTQQREVICVRKNADTFEVLDPSECSFLEKPPSQQSCHLKPCGAKWFSTEWSMCSKSCQGGFRVREVRCLSDDMTLSNLCDPQLKPEERESCNPQDCVPEVDENCKDKYYNCNVVVQARLCVYNYYKTACCASCTRVANRQTGFLGSR

SEQ ID NO: 13219 - protein, 101 aa, Homo Sapiens
MVSHFMGSLSVLCFLLLLGFQFVCPQPSTQHRKVPQRMAAEGAPEDDGGGGAPGVWGAWGPWSACSRSCSGGVMEQTRPCLPRSYRLRGGQRPGAPARAFA

SEQ ID NO: 13220 - protein, 1018 aa, Homo Sapiens
MVSHFMGSLSVLCFLLLLGFQFVCPQPSTQHRKVPQRMAAEGAPEDDGGGGAPGVWGAWGPWSACSRSCSGGVMEQTRPCLPRSYRLRGGQRPGAPARAFADHVVSAVRTSVPLHRSRDETPALAGTDASRQGPTVLRGSRHPQPQGLEVTGDRRSRTRGTIGPGKYGYGKAPYILPLQTDTAHTPQRLRRQKLSSRHSRSQGASSARHGYSSPAHQVPQHGPLYQSDSGPRSGLQAAEAPIYQLPLTHDQGYPAASSLFHSPETSNNHGVGTHGATQSFSQPARSTAISCIGAYRQYKLCNTNVCPESSRSIREVQCASYNNKPFMGRFYEWEPFAEVKGNRKCELNCQAMGYRFYVRQAEKVIDGTPCDQNGTAICVSGQCKSIGCDDYLGSDKVVDKCGVCGGDNTGCQVVSGVFKHALTSLGYHRVVEIPEGATKINITEMYKSNNYLALRSRSGRSIINGNWAIDRPGKYEGGGTMFTYKRPNEISSTAGESFLAEGPTNEILDVYMIHQQPNPGVHYEYVIMGTNAISPQVPPHRRPGEPFNGQMVTEGRSQEEGEQKGRNEEKEDLRGEAPEMFTSESAQTFPVRHPDRFSPHRPDNLVPPAPQPPRRSRDHNWKQLGTTECSTTCGKGSQYPIFRCVHRSTHEEAPESYCDSSMKPTPEEEPCNIFPCPAFWDIGEWSECSKTCGLGMQHRQVLCRQVYANRSLTVQPYRCQHLEKPETTSTCQLKICSEWQIRTDWTSCSVPCGVGQRTRDVKCVSNIGDVVDDEECNMKLRPNDIENCDMGPCAKSWFLTEWSERCSAECGAGVRTRSVVCMTNHVSSLPLEGCGNNRPAEATPCDNGPCTGKVEWFAGSWSQCSIECGSGTQQREVICVRKNADTFEVLDPSECSFLEKPPSQQSCHLKPCGAKWFSTEWSMCSKSCQGGFRVREVRCLSDDMTLSNLCDPQLKPEERESCNPQDCVPEVDENCKDKYYNCNVVVQARLCVYNYYKTACCASCTRVANRQTGFLGSR

SEQ ID NO: 13221 - protein, 37 aa, Homo Sapiens
MNLAISIALLLTGLPRAEGDQPNGLPSGPEPSSGLPP

SEQ ID NO: 13222 - protein, 144 aa, Homo Sapiens
MNLAISIALLLTVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 13223 - protein, 153 aa, Homo Sapiens
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLL

SEQ ID NO: 13224 - protein, 161 aa, Homo Sapiens
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 13225 - protein, 161 aa, Homo Sapiens; identical to SEQ ID NO: 13224

SEQ ID NO: 13226 - protein, 165 aa, Homo Sapiens
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRGHGFHVPVTGGAHGGDRKPQVPVQRSYFSESADPLPPIPQT

SEQ ID NO: 13227 - protein, 1138 aa, Homo Sapiens
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEACAPGHFGADCRLQCQCQNGGTCDRFSGCVCPSGWHGVHCEKSDRIPQILNMASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTKQSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLVPGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 13228 - protein, 379 aa, Homo Sapiens
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEACAPGHFGADCRLQCQCQNGGTCDRFSGCVCPSGWHGVHCEKSGWRDWVDTSTEKQNTDEGRFGGHVSAPVGAPG

SEQ ID NO: 13229 - protein, 71 aa, Homo Sapiens
MEVPPPAPRSFLCRALCLFPRVFAAEAVTADSEVLEERQKRLPYVPEPYYPESGWDRLRELFGKDCHGKSF

SEQ ID NO: 13230 - protein, 175 aa, Homo Sapiens
MEVPPPAPRSFLCRALCLFPRVFAAEAVTADSEVLEERQKRLPYVPEPYYPESGWDRLRELFGKDEQQRISKDLANICKTAATAGIIGWVYGGIPAFIHAKQQYIEQSQAEIYHNRFDAVQSAHRAATRGFIRYGWRWGWRTAVFVTIFNTVNTSLNVYRNKDALSHFVIAGALL

SEQ ID NO: 13231 - protein, 285 aa, Homo Sapiens
MEVPPPAPRSFLCRALCLFPRVFAAEAVTADSEVLEERQKRLPYVPEPYYPESGWDRLRELFGKDEQQRISKDLANICKTAATAGIIGWVYGGIPAFIHAKQQYIEQSQAEIYHNRFDAVQSAHRAATRGFIRYGWRWGWRTAVFVTIFNTVNTSLNVYRNKDALSHFVIAGAVTGSLFRINVGLRGLVAGGIIGALLGTPVGGLLMAFQKYSGETVQERKQKDRKALHELKLEEWKGRLQVTEHLPEKIESSLQEDEPENDAKKIEALLNLPRNPSVIDKQDKD

SEQ ID NO: 13232 - protein, 90 aa, Homo Sapiens
MEVPPPAPRSFLCRALCLFPRVFAAEAVTADSEVLEERQKRLPYVPEPYYPESGWDRLRELFGKDNLHIVLPHEASFVMAGAGVGELQCL

SEQ ID NO: 13233 - protein, 151 aa, Homo Sapiens
MEVPPPAPRSFLCRALCLFPRVFAAEAVTADSEVLEERQKRLPYVPEPYYPESGWDRLRELFGKDTPVGGLLMAFQKYSGETVQERKQKDRKALHELKLEEWKGRLQVTEHLPEKIESSLQEDEPENDAKKIEALLNLPRNPSVIDKQDKD

SEQ ID NO: 13234 - protein, 150 aa, Homo Sapiens
MEVPPPAPRSFLCRALCLFPRVFAAEAVTADSEVLEERQKRLPYVPEPYYPESGWDRLRELFGKDTVNTSLNVYRNKDALSHFVIAGAVTGSLFRINVGLRGLVAGGIIGALLGTPVGGLLMAFQKYSGETVQERKQKDRKALHELKLEE

SEQ ID NO: 13235 - protein, 65 aa, Homo Sapiens
MEVPPPAPRSFLCRALCLFPRVFAAEAVTADSEVLEERQKRLPYVPEPYYPESGWDRLRELFGKE

SEQ ID NO: 13236 - protein, 38 aa, Homo Sapiens
  misc_feature (1)..(1): Xaa can be any naturally occurring amino acid
XTADSEVLEERQKRLPYVPEPYYPESGWDRLRELFGKE

SEQ ID NO: 13237 - protein, 136 aa, Homo Sapiens
MAPFEPLASGILLLLWLIAPSRACTCVPPHPQTAFCNSDLVIRAKFVGTPEVNQTTLYQRYEIKMTKMYKGFQALGDAADIRFVYTPAMESVCGYFHRSHNRSEEFLIAGEAPSPRPVPHQPVPGARPSNHEGARL

SEQ ID NO: 13238 - protein, 207 aa, Homo Sapiens
MAPFEPLASGILLLLWLIAPSRACTCVPPHPQTAFCNSDLVIRAKFVGTPEVNQTTLYQRYEIKMTKMYKGFQALGDAADIRFVYTPAMESVCGYFHRSHNRSEEFLIAGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 13239 - protein, 96 aa, Homo Sapiens [sequence omitted]

SEQ ID NO: 13240 - protein, 143 aa, Homo Sapiens
MTKMYKGFQALGDAADIRFVYTPAMESVCGYFHRSHNRSEEFLIAGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 13241 - protein, 165 aa, Homo Sapiens
  misc_feature (1)..(1): Xaa can be any naturally occurring amino acid
XPRALCHTNQSLGRGLATTRGRGSDGNGPTGNGDHPNFSLSEGRAFGSLAAQPITSCLSVPAPPFSLGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 13242 - protein, 143 aa, Homo Sapiens
MFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 13243 - protein, 143 aa, Homo Sapiens; identical to SEQ ID NO: 13242

SEQ ID NO: 13244 - protein, 143 aa, Homo Sapiens; identical to SEQ ID NO: 13242

SEQ ID NO: 13245 - protein, 109 aa, Homo Sapiens
MFKGPEKDIEFIYTAPSSAVCGVSLDVGGKKEYLIAGKAEGDGKMHITLCDFIVPWDTLSTTQKKSLNHRYQMGCECKVSRSCLCWSIASSQCLQMDGRDFDPWLSRTR

SEQ ID NO: 13246 - protein, 220 aa, Homo Sapiens
MGAAARTLRLALGLLLLATLLRPADACSCSPVHPQQAFCNADVVIRAKAVSEKEVDSGNDIYGNPIKRIQYEIKQIKMFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 13247 - protein, 211 aa, Homo Sapiens
MTPWLGLIVLLGSWSLGDWGAEACTCSPSHPQDAFCNSDIVIRAKVVGKKLVKEGPFGTLVYTIKQMKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDP

SEQ ID NO: 13248 - protein, 224 aa, Homo Sapiens
MPGSPRPAPSWVLLLRLLALLRPPGLGEACSCAPAHPQQHICHSALVIRAKISSEKVVPASADPADTEKMLRYEIKQIKMFKGFEKVKDVQYIYTPFDSSLCGVKLEANSQKQYLLTGQVLSDGKVFIHLCNYIEPWEDLSLVQRESLNHHYHLNCGCQITTCYTVPCTISAPNECLWTDWLLERKLYGYQAQHYVCMKHVDGTCSWYRGHLPLRKEFVDIVQP

SEQ ID NO: 13249 - protein, 362 aa, Homo Sapiens
MHGGRIYPVLGTYWDNCNRCTCQENRQWQCDQEPCLVDPDMIKAINQGNYGWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 13250 - protein, 467 aa, Homo Sapiens
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCTCQENRQWQCDQEPCLVDPDMIKAINQGNYGWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 13251 - protein, 436 aa, Homo Sapiens
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 13252 - protein, 85 aa, Homo Sapiens
GGRALKENPVDLPATEQKENCLDCYMDPLRLSLLPPRARKPVCPPSLCSSVITIGDLVLDSDEEENGQGEGKVSGKEQKAGKGDG

SEQ ID NO: 13253 - protein, 71 aa, Homo Sapiens
MATPLVAGPAALRFAAAASWQVVRGRCVEHFPRVLEFLRSLRAVAPGLVRYRHHERLCMGLKAKSALLLTQ

SEQ ID NO: 13254 - protein, 416 aa, Homo Sapiens
MATPLVAGPAALRFAAAASWQVVRGRCVEHFPRVLEFLRSLRAVAPGLVRYRHHERLCMGLKAKTKQDLRKILEAQETFYQQVKQLSEAPVDLASKLQELEQEYGEPFLAAMEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLPATEQKENCLDCYMDPLRLSLLPPRARKPVCPPSLCSSVITIGDLVLDSDEEENGQGEGKESLENYQKTKFDTLIPTLCEYLPPSGHGAIPVSSCDCRDSSRPL

SEQ ID NO: 13255 - protein, 451 aa, Homo Sapiens
MATPLVAGPAALRFAAAASWQVVRGRCVEHFPRVLEFLRSLRAVAPGLVRYRHHERLCMGLKAKVVVELILQGRPWAQVLKALNHHFPESGPIVRDPKATKQDLRKILEAQETFYQQVKQLSEAPVDLASKLQELEQEYGEPFLAAMEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLPATEQKENCLDCYMDPLRLSLLPPRARKPVCPPSLCSSVITIGDLVLDSDEEENGQGEGKESLENYQKTKFDTLIPTLCEYLPPSGHGAIPVSSCDCRDSSRPL

SEQ ID NO: 13256 - protein, 354 aa, Homo Sapiens
MATPLVAGPAALRFAAAASWQVVRGRCVEHFPRVLEFLRSLRAVAPGLVRYRHHERLCMGLKAKVVVELILQGRPWAQVLKALNHHFPESGPIVRDPKATKQDLRKILEAQETFYQQVKQLSEAPVDLASKLQELEQEYGEPFLAAMEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLPATEQKE

SEQ ID NO: 13257 - protein, 451 aa, Homo Sapiens; identical to SEQ ID NO: 13255

SEQ ID NO: 13258 - protein, 290 aa, Homo Sapiens
MATPLVAGPAALRFAAAASWQVVRGRCVEHFPRVLEFLRSLRAVAPGLVRYRHHERLCMGLKAKVVVELILQGRPWAQVLKALNHHFPESGPIVRDPKATKQDLRKILEAQETFYQQVKQLSEAPVDLASKLQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTG

SEQ ID NO: 13259 - protein, 140 aa, Homo Sapiens
MATPLVAGPAALRFAAAASWQVVRGRCVEHFPRVLEFLRSLRAVAPGLVRYRHHERLCMGLKAKVVVELILQGRPWAQVLKALNHHFPESGPIVRDPKATKQDLRKILEAQETFYQQVKQLSEAPVDLASKLQSALLLTQ

SEQ ID NO: 13260 - protein, 140 aa, Homo Sapiens; identical to SEQ ID NO: 13259

SEQ ID NO: 13261 - protein, 146 aa, Homo Sapiens
MEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRN

SEQ ID NO: 13262 - protein, 1015 aa, Homo Sapiens
MPRATALGALVSLLLLLPLPRGAGGLGERPDATADYSELDGEEGTEQQLEHYHDPCKAAVFWGDIALDEDDLKLFHIDKARDWTKQTVGATGHSTGGLEEQASESSPDTTAMDTGTKEAGKDGRENTTLLHSPGTLHAAAKTFSPRVRRATTSRTERIWPGGVIPYVIGGNFTGSQRAIFKQAMRHWEKHTCVTFIERTDEESFIVFSYRTCGCCSYVGRRGGGPQAISIGKNCDKFGIVAHELGHVVGFWHEHTRPDRDQHVTIIRENIQPGQEYNFLKMEAGEVSSLGETYDFDSIMHYARNTFSRGVFLDTILPRQDDNGVRPTIGQRVRLSQGDIAQARKLYKCPACGETLQDTTGNFSAPGFPNGYPSYSHCVWRISVTPGEKIVLNFTSMDLFKSRLCWYDYVEVRDGYWRKAPLLGRFCGDKIPEPLVSTDSRLWVEFRSSSNILGKGFFAAYEATCGGDMNKDAGQIQSPNYPDDYRPSKECVWRITVSEGFHVGLTFQAFEIERHDSCAYDYLEVRDGPTEESALIGHFCGYEKPEDVKSSSNRLWMKFVSDGSINKAGFAANFFKEVDECSWPDHGGCEHRCVNTLGSYKCACDPGYELAADKKMCEVACGGFITKLNGTITSPGWPKEYPTNKNCVWQVVAPAQYRISLQFEVFELEGNDVCKYDFVEVRSGLSPDAKLHGRFCGSETPEVITSQSNNMRVEFKSDNTVSKRGFRAHFFSDKDECAKDNGGCQHECVNTFGSYLCRCRNGYWLHENGHDCKEAGCAHKISSVEGTLASPNWPDKYPSRRECTWNISSTAGHRVKLTFNEFEIEQHQECAYDHLEMYDGPDSLAPILGRFCGSKKPDPTVASGSSMFLRFYSDASVQRKGFQAVHSTECGGRLKAEVQTKELYSHAQFGDNNYPSEARCDWVIVAEDGYGVELTFRTFEVEEEADCGYDYMEAYDGYDSSAPRLGRFCGSGPLEEIYSAGDSLMIRFRTDDTINKKGFHARYTSTKFQDALHMKK

SEQ ID NO: 13263 - protein, 23 aa, Homo Sapiens
MTSIFHFAIIFMLILQIRIQLSE

SEQ ID NO: 13264 - protein, 48 aa, Homo Sapiens
MTSIFHFAIIFMLILQIRIQLSEESEFLVDRSKNGLIHVPKDLSQKTT

SEQ ID NO: 13265 - protein, 90 aa, Homo Sapiens
MTSIFHFAIIFMLILQIRIQLSEESEFLVDRSKNGLIHVPKDLSQKTTILNISQNYISELWTSDILSLSKLRILIISHNRIQYLDISVFK

SEQ ID NO: 13266 - protein, 161 aa, Homo Sapiens
MTSIFHFAIIFMLILQIRIQLSEESEFLVDRSKNGLIHVPKDLSQKTTILNISQNYISELWTSDILSLSKLRILIISHNRIQYLDISVFKFNQELEYLDLSHNKLVKISCHPTVNLKHLDLSFNAFDALPICKEFGNMSQLKFLGLSTTHLEKSSVLPIAH

SEQ ID NO: 13267 - protein, 786 aa, Homo Sapiens
MTSIFHFAIIFMLILQIRIQLSEESEFLVDRSKNGLIHVPKDLSQKTTILNISQNYISELWTSDILSLSKLRILIISHNRIQYLDISVFKFNQELEYLDLSHNKLVKISCHPTVNLKHLDLSFNAFDALPICKEFGNMSQLKFLGLSTTHLEKSSVLPIAHLNISKVLLVLGETYGEKEDPEGLQDFNTESLHIVFPTNKEFHFILDVSVKTVANLELSNIKCVLEDNKCSYFLSILAKLQTNPKLSNLTLNNIETTWNSFIRILQLVWHTTVWYFSISNVKLQGQLDFRDFDYSGTSLKALSIHQVVSDVFGFPQSYIYEIFSNMNIKNFTVSGTRMVHMLCPSKISPFLHLDFSNNLLTDTVFENCGHLTELETLILQMNQLKELSKIAEMTTQMKSLQQLDISQNSVSYDEKKGDCSWTKSLLSLNMSSNILTDTIFRCLPPRIKVLDLHSNKIKSIPKQVVKLEALQELNVAFNSLTDLPGCGSFSSLSVLIIDHNSVSHPSADFFQSCQKMRSIKAGDNPFQCTCELGEFVKNIDQVSSEVLEGWPDSYKCDYPESYRGTLLKDFHMSELSCNITLLIVTIVATMLVLAVTVTSLCSYLDLPWYLRMVCQWTQTRRRARNIPLEELQRNLQFHAFISYSGHDSFWVKNELLPNLEKEGMQICLHERNFVPGKSIVENIITCIEKSYKSIFVLSPNFVQSEWCHYELYFAHHNLFHEGSNSLILILLEPIPQYSIPSSYHKLKSLMARRTYLEWPKEKSKRGLFWANLRAAINIKLTEQAKK

SEQ ID NO: 13268 - protein, 786 aa, Homo Sapiens; identical to SEQ ID NO: 13267

SEQ ID NO: 13269 - protein, 627 aa, Homo Sapiens
MLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRGMFKSHCILNWPVQKERIGAFRHKLQVALGSKNSVH

SEQ ID NO: 13270 - protein, 904 aa, Homo Sapiens
MRQTLPCIYFWGGLLPFGMLCASSTTKCTVSHEVADCSHLKLTQVPDDLPTNITVLNLTHNQLRRLPAANFTRYSQLTSLDVGFNTISKLEPELCQKLPMLKVLNLQHNELSQLSDKTFAFCTNLTELHLMSNSIQKIKNNPFVKQKNLITLDLSHNGLSSTKLGTQVQLENLQELLLSNNKIQALKSEELDIFANSSLKKLELSSNQIKEFSPGCFHAIGRLFGLFLNNVQLGPSLTEKLCLELANTSIRNLSLSNSQLSTTSNTTFLGLKWTNLTMLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRGMFKSHCILNWPVQKERIGAFRHKLQVALGSKNSVH

SEQ ID NO: 13271 - protein, 351 aa, Homo Sapiens
MRQTLPCIYFWGGLLPFGMLCASSTTKCTVSHEVADCSHLKLTQVPDDLPTNITVLNLTHNQLRRLPAANFTRYSQLTSLDVGFNTISKLEPELCQKLPMLKVLNLQHNELSQLSDKTFAFCTNLTELHLMSNSIQKIKNNPFVKQKNLITLDLSHNGLSSTKLGTQVQLENLQELLLSNNKIQALKSEELDIFANSSLKKLELSSNQIKEFSPGCFHAIGRLFGLFLNNVQLGPSLTEKLCLELANTSIRNLSLSNSQLSTTSNTTFLGLKWTNLTMLDLSYNNLNVWLKCLEHLNMEDNDIPGIKSNMFTGLINLKYLSLSNSFTSLRTLTNETFVSLAHSPLHILNLT

SEQ ID NO: 13272 - protein, 45 aa, Homo Sapiens
MKKCLLPVLITCMQTAICKDRMMMIMILLVNYRPDEFIECEDPVD

SEQ ID NO: 13273 - protein, 121 aa, Homo Sapiens
MKKCLLPVLITCMQTAICKDRMMMIMILLVNYRPDEFIECEDPVDHVGNATASQELGYGCLKFGGQAYSDVEHTSVQCHALDGIECASPRTFLRENKPCIKYTGHYFITTLLYSFFLGCFG

SEQ ID NO: 13274 - protein, 171 aa, Homo Sapiens
MKKCLLPVLITCMQTAICKDRMMMIMILLVNYRPDEFIECEDPVDHVGNATASQELGYGCLKFGGQAYSDVEHTSVQCHALDGIECASPRTFLRENKPCIKYTGHYFITTLLYSFFLGCFGVDRFCLGHTGTAVGKLLTLGGLGIWWFVDLILLITGGLMPSDGSNWCTVY

SEQ ID NO: 13275 - protein, 171 aa, Homo Sapiens; identical to SEQ ID NO: 13274

SEQ ID NO: 13276 - protein, 63 aa, Homo Sapiens
MKKCLLPVLITCMQTAICKDRMMMIMILLVNYRPDEFIECEDPVDHVGNATASQELGYGCLKV

SEQ ID NO: 13277 - protein, 214 aa, Homo Sapiens
MVLGGCPVSYLLLCGQAALLLGNLLLLHCVSRSHSQNATAEPELTSAGAAQPEGPGGAASWEYGDPHSPVILCSYLPDEFIECEDPVDHVGNATASQELGYGCLKFGGQAYSDVEHTSVQCHALDGIECASPRTFLRENKPCIKYTGHYFITTLLYSFFLGCFGVDRFCLGHTGTAVGKLLTLGGLGIWWFVDLILLITGGLMPSDGSNWCTVY

SEQ ID NO: 13278 - protein, 247 aa, Homo Sapiens
MAGGVLPLRGLRALCRVLLFLSQFCILSGGEQSQALAQSIKDPGPTRTFTVVPRAAESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 13279 - protein, 209 aa, Homo Sapiens
MAGGVLPLRGLRALCRVLLFLSQFCILSGGEQSQALAQSIKDPGPTRTFTVVPRAAESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSLQAQVGLHVQLTVGLH

SEQ ID NO: 13280 - protein, 221 aa, Homo Sapiens
MAGGVLPLRGLRALCRVLLFLSQFCILSGGESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 13281 - protein, 183 aa, Homo Sapiens
MAGGVLPLRGLRALCRVLLFLSQFCILSGGESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSLQAQVGLHVQLTVGLH

SEQ ID NO: 13282 - protein, 42 aa, Homo Sapiens
MAGGVLPLRGLRALCRVLLFLSQFCILSGGGESKAGFSAGWG

SEQ ID NO: 13283 - protein, 182 aa, Homo Sapiens
MKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 13284 - protein, 21 aa, Homo Sapiens
  misc_feature (1)..(1): Xaa can be any naturally occurring amino acid
XQFCILSGGGESKAGFSAGWG

SEQ ID NO: 13285 - protein, 161 aa, Homo Sapiens
  misc_feature (1)..(1): Xaa can be any naturally occurring amino acid
XSTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALRVGLFIDTVTTPLHSSLSHRARHCL

SEQ ID NO: 13286 - protein, 152 aa, Homo Sapiens
ETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLAVLYLLLCLSTSSPSFITGLF

SEQ ID NO: 13287 - protein, 81 aa, Homo Sapiens
FYILITRLTPIKYDGNLKIFHDDGVFWVTFSCIAILIPVVFMGCLRILNILTCGVIGSYSVVLAIDSYWSTSLSYITLNVL

SEQ ID NO: 13288 - protein, 37 aa, Homo Sapiens
MAILLSYSERDPVPGGCNLEFDLDIDPNIYLEYNFFE

SEQ ID NO: 13289 - protein, 66 aa, Homo Sapiens
MAILLSYSERDPVPGGCNLEFDLDIDPNIYLEYNFFETTIKFAPANLGYARGVDPPPCDAGTDQDS

SEQ ID NO: 13290 - protein, 86 aa, Homo Sapiens
MAILLSYSERDPVPGGCNLEFDLDIDPNIYLEYNFFETTIKFAPANLGYARGVDPPPCDAGTDQDSRWRLQYDVYQYFLPENDLTE

SEQ ID NO: 13291 - protein, 129 aa, Homo Sapiens [sequence omitted]

SEQ ID NO: 13292 - protein, 49 aa, Homo Sapiens
MGFLQLLVVAVLASEHRVAGAAEVFGNSSEDSPFQFLGNRHCQWTGFHP

SEQ ID NO: 13293 - protein, 570 aa, Homo Sapiens
MGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 13294 - protein, 116 aa, Homo Sapiens
MGFLQLLVVAVLASEHRVAGAAEVFGNSSEVYLVVGLIEFSVGKFRYFELNRPFPEEAILHDISSNVTFLIFQIHSQYQNTTVSFSPTLLSNSSETGTASGLVFILRPEQSTCTWY

SEQ ID NO: 13295 - protein, 136 aa, Homo Sapiens
MLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYD

SEQ ID NO: 13296 - protein, 136 aa, Homo Sapiens; identical to SEQ ID NO: 13295

SEQ ID NO: 13297 - protein, 115 aa, Homo Sapiens
MSHRARPISGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVP

SEQ ID NO: 13298 - protein, 222 aa, Homo Sapiens
VWDPFLNTSAAYIPAHTYACSFEAGEGSCASLELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERG

SEQ ID NO: 13299 - protein, 200 aa, Homo Sapiens
  misc_feature (1)..(1): Xaa can be any naturally occurring amino acid
XLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLETGSLSVTHAGLQ

SEQ ID NO: 13300 - protein, 144 aa, Homo Sapiens
  misc_feature (1)..(1): Xaa can be any naturally occurring amino acid
XVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDAEHTDLWSHWLLFGGFSH

SEQ ID NO: 13301 - protein, 208 aa, Homo Sapiens
MAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHT

SEQ ID NO: 13302 - protein, 519 aa, Homo Sapiens
MAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 13303 - protein, 133 aa, Homo Sapiens
MTVVGNPRSWSCQWLPILILLLGTALVQVYCHPHDCWRLPAFQCHLCGAVLHLCHSMGSGAVHFVRHPLLCLRHPAECGGLHLHCTHLLPVVWGGLPLVVAICAECWLHRPLHLPLLSFLLCPALQHVWGSTD

SEQ ID NO: 13304 - protein, 210 aa, Homo Sapiens
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSE

SEQ ID NO: 13305 - protein, 242 aa, Homo Sapiens
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINS

SEQ ID NO: 13306 - protein, 606 aa, Homo Sapiens
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 13307 - protein, 489 aa, Homo Sapiens
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFRYPPFIPWLLLSGS

SEQ ID NO: 13308 - protein, 257 aa, Homo Sapiens
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVIL

SEQ ID NO: 13309 - protein, 420 aa, Homo Sapiens
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSGSASHNHPAASDGLAAGGLSPHCHWRHLWEEQRQPL

SEQ ID NO: 13310 - protein, 589 aa, Homo Sapiens
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPCAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 13311 - protein, 301 aa, Homo Sapiens
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFP

SEQ ID NO: 13312 - protein, 57 aa, Homo Sapiens
MRTLVGLLTSNQALLQLEAARCLHELSHSEQSTVAEACLPATSYLLTYLSSHSSDFI

SEQ ID NO: 13313 - protein, 499 aa, Homo Sapiens
MWSRRQGRLRPTVCGVEELRRRRREREAALRKARREQQLVSKRLLRNDAPEEAGEGCVAAILGETEVQQFLRQAQRGTEEKEREGALVSLRRGLQHPETQQTFIRLEGSMRTLVGLLTSNQALLQLEAARCLHELSHSEQSTVAEACLPATSYLLTYLSSHSSDFIELCLYTLGNLIVESEAVRRQLLPQGIVPALAACIQSPHVAVLEALGYALSQLLQAEEAPEKIIPPASASSSILASTLPQHMLQMLQPGPKLNPGVAVEFAWCLHYIICSQVSNPLLIGHGALSTLGLLLLDLAGAVQKTEDAGLELLACPVLRCLSNLLTEAAVETVGGQMQLRDERVVAALFILLQFFFQKQPSLLPEGLWLLNNLTANSPSFCTSLLSLDLIEPLLQLLPVSNVVSVMVLTVLCNVAEKGPAYCQRLWPGPLLPALLHTLAFSDTEVVGQSLELLHLLFLYQPEAVQVFLQQSGLQALERHQEEAQLQDRVYALQQTALQG

SEQ ID NO: 13314 - protein, 493 aa, Homo Sapiens
MWSRRQGRLRPTVCGVEELRRRRREREAALRKARREQQLVSKRLLRNDAPEEAGEGCVAAILGETEVQQFLRQAQRGTEEKEREGALVSLRRGLQHPETQQTFIRLEGSMRTLVGLLTSNQALLQLEAARCLHELSHSEQSTVAEACLPATSYLLTYLSSHSSDFIELCLYTLGNLIVESEAVRRQLLPQGIVPALAACIQSPHVAVLEALGYALSQLLQAEEAPEKIIPSILASTLPQHMLQMLQPGPKLNPGVAVEFAWCLHYIICSQVSNPLLIGHGALSTLGLLLLDLAGAVQKTEDAGLELLACPVLRCLSNLLTEAAVETVGGQMQLRDERVVAALFILLQFFFQKQPSLLPEGLWLLNNLTANSPSFCTSLLSLDLIEPLLQLLPVSNVVSVMVLTVLCNVAEKGPAYCQRLWPGPLLPALLHTLAFSDTEVVGQSLELLHLLFLYQPEAVQVFLQQSGLQALERHQEEAQLQDRVYALQQTALQG

SEQ ID NO: 13315 - protein, 101 aa, Homo Sapiens
MWSRRQGRLRPTVCGVEELRRRRREREAALRKARREQQLVSKRLLRNDAPEEAGEGCVAAILGETEVRGQGAAVPAASPAGDRGKGERGGSGQPSSRLAAP

SEQ ID NO: 13316 - protein, 43 aa, Homo Sapiens
MWSRRQGRLRPTVCGVEELRRRRREREHCGRRGGSSSWSARGC

SEQ ID NO: 13317 - protein, 43 aa, Homo Sapiens; identical to SEQ ID NO: 13316

SEQ ID NO: 13318 - protein, 43 aa, Homo Sapiens; identical to SEQ ID NO: 13316

SEQ ID NO: 13319 - protein, 43 aa, Homo Sapiens; identical to SEQ ID NO: 13316

SEQ ID NO: 13320 - protein, 82 aa, Homo Sapiens
MLDVKMEDIKESIETMRTRLERSIQMLTLLRAFEARDRNLQEGNLERVNFWSAVNVAVLLLVAVLQVCTLKRFFQDKRPVPT

SEQ ID NO: 13321 - protein, 74 aa, Homo Sapiens
MMAAGAALALALWLLMPPVEVGGAGPPPIQDGEFTFLLPAGRKQCFYQSAPANASLETEYQGGANGGRGLQAVL

SEQ ID NO: 13322 - protein, 95 aa, Homo Sapiens
MMAAGAALALALWLLMPPVEVGGAGPPPIQDGEFTFLLPAGRKQCFYQSAPANASLETEYQVIGGAGLDVDFTLESPQGVLLGGANGGRGLQAVL

SEQ ID NO: 13323 - protein, 185 aa, Homo Sapiens
MMAAGAALALALWLLMPPVEVGGAGPPPIQDGEFTFLLPAGRKQCFYQSAPANASLETEYQVIGGAGLDVDFTLESPQGVLLVSESRKADGVHTSPLRPCGPGWSAASRCSRYCGPSRHVTATCKRATWSGSTSGQLSTWRCCCWWLCCRSARSSASSRTSARCPRSPCHGRKNGTKEGQQGVCI

SEQ ID NO: 13324 - protein, 191 aa, Homo Sapiens
MMAAGAALALALWLLMPPVEVGGAGPPPIQDGEFTFLLPAGRKQCFYQSAPANASLETEYQVIGGAGLDVDFTLESPQGVLLVSESRKADGVHTTISEKLVFFELIFDSLQDDEEVEGWAEAVEPEEMLDVKMEDIKESIETMRTRLERSIQMLTLLRAFEARDRNLQEGNLERVNFWSAVNVAVLLLVAV

SEQ ID NO: 13325 - protein, 227 aa, Homo Sapiens
MMAAGAALALALWLLMPPVEVGGAGPPPIQDGEFTFLLPAGRKQCFYQSAPANASLETEYQVIGGAGLDVDFTLESPQGVLLVSESRKADGVHTVEPTEAGDYKLCFDNSFSTISEKLVFFELIFDSLQDDEEVEGWAEAVEPEEMLDVKMEDIKESIETMRTRLERSIQMLTLLRAFEARDRNLQEGNLERVNFWSAVNVAVLLLVAVLQVCTLKRFFQDKRPVPT

SEQ ID NO: 13326 - protein, 65 aa, Homo Sapiens
  misc_feature (1)..(1): Xaa can be any naturally occurring amino acid
XEVEGWAEAVEPEEMLDVKMEDIKVCPGCAGATPSRSLGFTWGAPLGLTQPPLRSCALQLNYRVH

SEQ ID NO: 13327 - protein, 116 aa, Homo Sapiens
MDGTYKFCFSNRMSTMTPKIVMFTIDIGEAPKGQDMETEAHQNKLEEMINELAVAMTAVKHEQEYMEVRERIHRAINDNTNSRVVLWSFFEALVLVAMTLGQIYYLKRFFEVRRVV

SEQ ID NO: 13328 - protein, 201 aa, Homo Sapiens
MVTLAELLVLLAALLATVSGYFVSIDAHAEECFFERVTSGTKMGLIFEVAEGGFLDIDVEITGPDNKGIYKGDRESSGKYTFAAHMDGTYKFCFSNRMSTMTPKIVMFTIDIGEAPKGQDMETEAHQNKLEEMINELAVAMTAVKHEQEYMEVRERIHRAINDNTNSRVVLWSFFEALVLVAMTLGQIYYLKRFFEVRRVV

SEQ ID NO: 13329 - protein, 166 aa, Homo Sapiens
MVTLAELLVLLAALLATVSGYFVSIDAHAEECFFERVTSGTKMGLIFEVAEGGFLDIDVEITGPDNKGIYKGDRESSGKYTFAAHMDGTYKFCFSNRMSTMTPKIVMFTIDIGEAPKGQDMETEGGGDTWDAHQNKLEEMINELAVAMTAVKHEQEYMEVRERIHR

SEQ ID NO: 13330 - protein, 146 aa, Homo Sapiens
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQGFRVFCL

SEQ ID NO: 13331 - protein, 155 aa, Homo Sapiens
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQGPSASPTPTPPLRVPV

SEQ ID NO: 13332 - protein, 217 aa, Homo Sapiens
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQMESACVTIHEALKTVIDSQTHYRLREAQDRARAEDLNSRVSYWSVGETIALFVVSFSQVLLLKSFFTEKRPISRAVHS

SEQ ID NO: 13333 - protein, 173 aa, Homo Sapiens
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQRFRGAYWKEVDKMVDYMQPGGTPATEGLGRLAPS

SEQ ID NO: 13334 - protein, 186 aa, Homo Sapiens
MAGVGAGPLRAMGRQALLLLALCATGAQGLYFHIGETEKRCFIEEIPDETMVIGNYRTQMWDKQKEVFLPSTPGLGMHVEVKDPDGKVVLSRQYGSEGRFTFTSHTPGDHQICLHSNSTRMALFAGGKLRVHLDIQVGEHANNYPEIAAKDKLTELQLRARQLLDQVEQIQKEQDYQRASAYLLVI

SEQ ID NO: 13335 - protein, 227 aa, Homo Sapiens
MAGVGAGPLRAMGRQALLLLALCATGAQGLYFHIGETEKRCFIEEIPDETMVIGNYRTQMWDKQKEVFLPSTPGLGMHVEVKDPDGKVVLSRQYGSEGRFTFTSHTPGDHQICLHSNSTRMALFAGGKLRVHLDIQVGEHANNYPEIAAKDKLTELQLRARQLLDQVEQIQKEQDYQRYREERFRLTSESTNQRVLWWSIAQTVILILTGIWQMRHLKSFFEAKKLV

SEQ ID NO: 13336 - protein, 178 aa, Homo Sapiens
MAGVGAGPLRAMGRQALLLLALCATGAQGLYFHIGETEKRCFIEEIPDETMVIGNYRTQMWDKQKEVFLPSTPGLGMHVEVKDPDGKVVLSRQYGSEGRFTFTSHTPGDHQICLHSNSTRMALFAGGKLYREERFRLTSESTNQRVLWWSIAQTVILILTGIWQMRHLKSFFEAKKLV

SEQ ID NO: 13337 - protein, 120 aa, Homo Sapiens
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTCIRSKNGPGTAVHAYNPSTFRGQV

SEQ ID NO: 13338 - protein, 193 aa, Homo Sapiens
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILDPIIKIASDVQIRLHLGIHQQHQVQTKQKWAHTNSA

SEQ ID NO: 13339 - protein, 229 aa, Homo Sapiens
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILESINSIKSRLSKSGHIQTLLRAFEARDRNIQESNFDRVNFWSMVNLVVMVVVSAIQVYMLKSLFEDKRKSRT

SEQ ID NO: 13340 - protein, 162 aa, Homo Sapiens
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILVSMVF

SEQ ID NO: 13341 - protein, 82 aa, Homo Sapiens
MPRPGSAQRWAAVAGRWGCRLLALLLLVPGPGGASEITFELPDNAKQCFYEDIAQGTKCTLEFQVITGGHYDVDCRLEDPDG

SEQ ID NO: 13342 - protein, 224 aa, Homo Sapiens
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAYWSVGEALILLVVSIGQVFLLKSFFSDKRTTTTRVGS

SEQ ID NO: 13343 - protein, 188 aa, Homo Sapiens
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAY

SEQ ID NO: 13344 - protein, 404 aa, Homo Sapiens
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAYWHSVDTSPGYHESDSKKSEDLSLCNVAEHSNTTEGPTGKQEGAQSVEEMFEEEAEEEVFLKFVILHAEDDTDEALRVQNLLQDDFGIKPGIIFAEMPCGRQHLQNLDDAVNGSAWTILLLTENFLRDTWCNFQFYTSLMNSVNRQHKYNSVIPMRPLNNPLPRERTPFALQTINALEEESRGFPTQVERIFQESVYKTQQTIWKETRNMVQRQFIA

SEQ ID NO: 13345 - protein, 72 aa, Homo Sapiens
MKRSLQALYCQLLSFLLILALTEALAFAIQEPSPRESLQVLPSGTPPGTMVTAPHSSTRHTSVVMLTPNPDG

SEQ ID NO: 13346 - protein, 149 aa, Homo Sapiens
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGA

SEQ ID NO: 13347 - protein, 153 aa, Homo Sapiens
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRP

SEQ ID NO: 13348 - protein, 575 aa, Homo Sapiens
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPGSSRKGAGNSSRPVPPAPGGHSRSKEGQRGRNPSSTPLGQKRPLGKIFQIYKGNFTGSVEPEPSTLTPRTPLWGYSSSPQPQTVAATTVPSNTSWAPTTTSLGPAKDKPGLRRAAQGGGSTFTSQGGTPDATAASGAPVSPQAAPVPSQRPHHGDPQDGPSHSDSWLTVTPGTSRPLSTSSGVFTAATGPTPAAFDTSVSAPSQGIPQGASTTPQAPTHPSRVSESTISGAKEETVATLTMTDRVPSPLSTVVSTATGNFLNRLVPAGTWKPGTAGNISHVAEGDKPQHRATICLSKMDIAWVILAISVPISSCSVLLTVCCMKRKKKTANPENNLSYWNNTITMDYFNRHAVELPREIQSLETSEDQLSEPRSPANGDYRDTGMVLVNPFCQETLFVGNDQVSEI

SEQ ID NO: 13349 - protein, 575 aa, Homo Sapiens; identical to SEQ ID NO: 13348

SEQ ID NO: 13350 - protein, 488 aa, Homo Sapiens
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPGSSRKGAGNSSRPVPPAPGGHSRSKEGQRGRNPSSTPLGQKRPLGKIFQIYKGNFTGSVEPEPSTLTPRTPLWGYSSSPQPQTVAATTVPSNTSWAPTTTSLGPAKDKPGLRRAAQGGGSTFTSQGGTPDATAASGAPVSPQAAPVPSQRPHHGDPQDGPSHSDSWLTVTPGTSRPLSTSSGVFTAATGPTPAAFDTSVSAPSQGIPQGASTTPQAPTHPSRVSESTISGAKEETVATLTMTDRVPSPLSTVVSTATGNFLNRLVPAGTWKPGTAGNISHVAEGDKPQHRATICLSKMDIAWVILAISVPISSCSDPIT

SEQ ID NO: 13351 - protein, 105 aa, Homo Sapiens
MKRSLQALYCQLLTVLLTVCCMKRKKKTANPENNLSYWNNTITMDYFNRHAVELPREIQSLETSEDQLSEPRSPANGDYRDTGMVLVNPFCQETLFVGNDQVSEI

SEQ ID NO: 13352 - protein, 89 aa, Homo Sapiens
MVTAPHSSTRHTSVVMLTPNPDGPPSQAAAPMATPTPRAEGHPPTHTISTIAATVTAPHSESSLSTGPAPAAMATTSSKPEGRPRGQAA

SEQ ID NO: 13353 - protein, 122 aa, Homo Sapiens
MVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPGS

SEQ ID NO: 13354 - protein, 51 aa, Homo Sapiens
MATLSVIGSSSLIAYAVFHNIQKSPEIRPLFYLSFCDLLLGLCWLTETLLY

SEQ ID NO: 13355 - protein, 80 aa, Homo Sapiens
MATLSVIGSSSLIAYAVFHNIQKSPEIRPLFYLSFCDLLLGLCWLTETLLYGASVANKDIICYNLQAVGQFWRLEGPRLR

SEQ ID NO: 13356 - protein, 80 aa, Homo Sapiens; identical to SEQ ID NO: 13355

SEQ ID NO: 13357 - protein, 85 aa, Homo Sapiens
MATLSVIGSSSLIAYAVFHNIQKSPEIRPLFYLSFCDLLLGLCWLTETLLYGASVANKDIICYNLQAVGQGRRGFAMFARLVLNA

SEQ ID NO: 13358 - protein, 106 aa, Homo Sapiens
MATLSVIGSSSLIAYAVFHNIQKSPEIRPLFYLSFCDLLLGLCWLTETLLYGASVANKDIICYNLQAVGQIFYISSFLYTVNYIWYLYTELRMKHTQSGQSTSPLV

SEQ ID NO: 13359 - protein, 175 aa, Homo Sapiens
MATLSVIGSSSLIAYAVFHNIQKSPEIRPLFYLSFCDLLLGLCWLTETLLYGASVANKDIICYNLQAVGQIFYISSFLYTVNYIWYLYTELRMKHTQSGQSTSPLVIDYTCRVCQMAFVFSSLIPLLLMTPVFCLGNTSECFQNFSQSHKCILMHSPPSAMAELPPSANTSVCST

SEQ ID NO: 13360 - protein, 337 aa, Homo Sapiens
MATLSVIGSSSLIAYAVFHNIQKSPEIRPLFYLSFCDLLLGLCWLTETLLYGASVANKDIICYNLQAVGQIFYISSFLYTVNYIWYLYTELRMKHTQSGQSTSPLVIDYTCRVCQMAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 13361 - protein, 302 aa, Homo Sapiens
MATLSVIGSSSLIAYAVFHNIQKSPEIRPLFYLSFCDLLLGLCWLTETLLYGASVANKDIICYNLQAVGQVIDYTCRVCQMAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 13362 - protein, 74 aa, Homo Sapiens
MATLSVIGSSSLIAYAVFHNIQKSPEIRPLFYLSFCDLLLGLCWLTETLLYGASVANKDIICYNLQAVGQVSAT

SEQ ID NO: 13363 - protein, 151 aa, Homo Sapiens
MFPKLQSEPQVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 13364 - protein, 104 aa, Homo Sapiens
MKHTQSGQSTSPLVIDYTCRVCQMAFVFSSLIPLLLMTPVFCLGNTSECFQNFSQSHKCILMHSPPSAMAELPPSANTSVCSTLYFYGIAIFLGSFVLSLLTIM

SEQ ID NO: 13365 - protein, 245 aa, Homo Sapiens
MKHTQSGQSTSPLVIDYTCRVCQMAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 13366 - protein, 28 aa, Homo Sapiens
MVSAAAPSLLILLLLLLGSVPATDARSV

SEQ ID NO: 13367 - protein, 44 aa, Homo Sapiens
MVSAAAPSLLILLLLLLGSVPATDARSVPLKATFLEDVAGSGEA

SEQ ID NO: 13368 - protein, 140 aa, Homo Sapiens
MVSAAAPSLLILLLLLLGSVPATDARSVPLKATFLEDVAGSGEAEGSSASSPSLPPPWTPALSPTSMGPQPITLGGPSPPTNFLDGIVDFFRQYVMLIAVVGSLAFLLMFIVCAAVITRQKQKASAYYPSSFPKKKYVDQ

SEQ ID NO: 13369 - protein, 283 aa, Homo Sapiens
MVSAAAPSLLILLLLLLGSVPATDARSVPLKATFLEDVAGSGEAEGSSASSPSLPPPWTPALSPTSMGPQPITLGGPSPPTNFLDGIVDFFRQYVMLIAVVGSLAFLLMFIVCAAVITRQKQKASAYYPSSFPKKKYVDQSDRAGGPRAFSEVPDRAPDSRPEEALDSSRQLQADILAATQNLKSPTRAALGGGDGARMVEGRGAEEEEKGSQEGDQEVQGHGVPVETPEAQEEPCSGVLEGAVVAGEGQGELEGSLLLAQEAQGPVGPPESPCACSSVHPSV

SEQ ID NO: 13370 - protein, 70 aa, Homo Sapiens
MASDLIRTILAVALISKLGTAVDAELMPSGAILQNKRENLPRVCHALAFLGMARCQDLFLVRLQGWKLGT

SEQ ID NO: 13371 - protein, 130 aa, Homo Sapiens
MASDLIRTILAVALISKLGTAVDAELMPSGAILQNKRENLPRVCHALAFLGMARCQDLFLVRLQGWKLGTRFQDGPRSTPQEEGGSPQRKRGMPVQIHFLLKSFLSSPITFAFISLARTVSLATAICKIV

SEQ ID NO: 13372 - protein, 130 aa, Homo Sapiens; identical to SEQ ID NO: 13371

SEQ ID NO: 13373 - protein, 130 aa, Homo Sapiens; identical to SEQ ID NO: 13371

SEQ ID NO: 13374 - protein, 258 aa, Homo Sapiens
FFSLLATAILGAVSWQPTNGIFLSMFLIVLPLESMAHGLFHELGNCLGGTSVGYAIVIPTNFCSGHTHGTGEWALAGGDTLRLDTLIEWWREKNGSFCSRLIIVLDSENSTPWVKEVRKINDQYIAVQGAELIKTVDIEEADPPQLGDFTKDWVEYNCNSSNNICWTEKGRTVKAVYGVSKRWSDYTLHLPTGSDVAKHWMLHFPRITYPLVHLANWLCGLNLFWICKTCFRCLKRLKMSWFLPTVLDTGQGFKLVKS

SEQ ID NO: 13375 - protein, 697 aa, Homo Sapiens
MCKSLRYCFSHCLYLAMTRLEEVNREVNMHSSVRYLGYLARINLLVAICLGLYVRWEKTANSLILVIFILGLFVLGIASILYYYFSMEAASLSLSNLWFGFLLGLLCFLDNSSFKNDVKEESTKYLLLTSIVLRILCSLVERISGYVRHRPTLLTTVEFLELVGFAIASTTMLVEKSLSVILLVVALAMLIIDLRMKSFLAIPNLVIFAVLLFFSSLETPKNPIAFACFFICLITDPFLDIYFSGLSVTERWKPFLYRGRICRRLSVVFAGMIELTFFILSAFKLRDTHLWYFVIPGFSIFGIFWMICHIIFLLTLWGFHTKLNDCHKVYFTHRTDYNSLDRIMASKGMRHFCLISEQLVFFSLLATAILGAVSWQPTNGIFLSMFLIVLPLESMAHGLFHELGNCLGGTSVGYAIVIPTNFCSPDGQPTLLPPEHVQELNLRSTGMLNAIQRFFAYHMIETYGCDYSTSGLSFDTLHSKLKAFLELRTVDGPRHDTYILYYSGHTHGTGEWALAGGDTLRLDTLIEWWREKNGSFCSRLIIVLDSENSTPWVKEVRKINDQYIAVQGAELIKTVDIEEADPPQLGDFTKDWVEYNCNSSNNICWTEKGRTVKAVYGVSKRWSDYTLHLPTGSDVAKHWMLHFPRITYPLVHLANWLCGLNLFWICKTCFRCLKRLKMSWFLPTVLDTGQGFKLVKS

SEQ ID NO: 13376 - protein, 697 aa, Homo Sapiens; identical to SEQ ID NO: 13375

SEQ ID NO: 13377 - protein, 124 aa, Homo Sapiens
MFLIVLPLESMAHGLFHELGNCLGGTSVGYAIVIPTNFCSPDGQPTLLPPEHVQELNLRSTGMLNAIQRFFAYHMIETYGCDYSTSGLSFDTLHSKLKAFLELRTVDGPRHDTYILYYSGHTHG

SEQ ID NO: 13378 - protein, 313 aa, Homo Sapiens
MFLIVLPLESMAHGLFHELGNCLGGTSVGYAIVIPTNFCSPDGQPTLLPPEHVQELNLRSTGMLNAIQRFFAYHMIETYGCDYSTSGLSFDTLHSKLKAFLELRTVDGPRHDTYILYYSGHTHGTGEWALAGGDTLRLDTLIEWWREKNGSFCSRLIIVLDSENSTPWVKEVRKINDQYIAVQGAELIKTVDIEEADPPQLGDFTKDWVEYNCNSSNNICWTEKGRTVKAVYGVSKRWSDYTLHLPTGSDVAKHWMLHFPRITYPLVHLANWLCGLNLFWICKTCFRCLKRLKMSWFLPTVLDTGQGFKLVKS

SEQ ID NO: 13379 - protein, 112 aa, Homo Sapiens
MRHFCLISEQLVFFSLLATAILGAVSWQPTNGIFLSMFLIVLPLESMAHGLFHELGNCLGGTSVGYAIVIPTNFCSPDGQPTLLPPEHVQELNLRSTGMLNAIQRFFAYHMI

SEQ ID NO: 13380 - protein, 111 aa, Homo Sapiens
MEPRALVTALSLGLSLCSLGLLVTAIFTDHWYETDPRRHKESCERSRAGADPPDQKNRLMPLSHLLGPLEEVLLPGHRPGHRHPHPERYCAAMHGHQVPLFSAHPLAKHSF

SEQ ID NO: 13381 - protein, 297 aa, Homo Sapiens
MEPRALVTALSLGLSLCSLGLLVTAIFTDHWYETDPRRHKESCERSRAGADPPDQKNRLMPLSHLPLRDSPPLGRRLLPGGPGRADPESWRSLLGLGGLDAECGRPLFATYSGLWRKCYFLGIDRDIDTLILKGIAQRCTAIKYHFSQPIRLRNIPFNLTKTIQQDEWHLLHLRRITAGFLGMAVAVLLCGCIVATVSFFWEESLTQHVAGLLFLMTGIFCTISLCTYAASISYDLNRLPKLIYSLPADVEHGYSWSIFCAWCSLGFIVAAGGLCIAYPFISRTKIAQLKSGRDSTV

SEQ ID NO: 13382 - protein, 233 aa, Homo Sapiens
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQFGLWASWLAWLAITTLAFLKVYHNYRQEDLLDSLIHEKELLLARPSPRTSFQEEKSAVI

SEQ ID NO: 13383 - protein, 190 aa, Homo Sapiens
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQGSLIDSHGVETPPGQS

SEQ ID NO: 13384 - protein, 197 aa, Homo Sapiens
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQVGGSGQEGRLAMLGGGHLLLDIC

SEQ ID NO: 13385 - protein, 211 aa, Homo Sapiens
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQVQFRTPGWPLKALAGRGWPEDASPGQEPSKGAGHGWA

SEQ ID NO: 13386 - protein, 182 aa, Homo Sapiens
MCTPVRVSIVCVMGAVGAVWTAPLPLPWAPTPSIHLREEGAAFPFCRVCVLRPRRSKWRSWDVNLGPRRRGLLGCGPCPSGKPRVHLQRTRSGAGAEAGGLPTRGSMRGCPFLGSSAAKCSLLLRPPSRGEASPWLPEFMTHPVHHQQLACVSGWLGTSLLEATCLGPHGGSWWGHHPGSRE

SEQ ID NO: 13387 - protein, 78 aa, Homo Sapiens
  misc_feature (1)..(1): Xaa can be any naturally occurring amino acid
XPDPREGAAAGPAVPTHLLPRGEERCHLGTVQAGGAGPDLPAALGGTGLPGEAAGGLCLGPGHMQPCVCPLDATCSEP

SEQ ID NO: 13388 - protein, 172 aa, Homo Sapiens
MCTSGQIIGSLLVLSVLEIGLGVSSVAVGAVSFSLALREHKPQLGDSSPFLLCGICGILCAKKKSGLVMILFSACCICGLIGGILNFQFLRAVTKKTSSLYPLHLASMSLACIGIGGCTLSSWLTCRLASYEQRRMFSEREHSLHHSHEMAEKEITDNMSNGGPQLIFNGRV

SEQ ID NO: 13389 - protein, 179 aa, Homo Sapiens
MCTSGQIIGSLLVLSVLEIGLGVSSVAVGAVSFSLALREHKPQLGDSSPFLLCGICGILCAKKKSGLVMILFSACCICGLIGGILNFQFLRAVTKKTSSLYPLHLASMSLACIGIGGCTLSSWLTCRLASYEQRRMFSEREHSLHHSHEMAEKRLRAIEITDLPSCPVVPPTPELPTRK

SEQ ID NO: 13390 - protein, 104 aa, Homo Sapiens
MILFSACCICGLIGGILNFQFLRAVTKKTSSLYPLHLASMSLACIGIGGCTLSSWLTCRLASYEQRRMFSEREHSLHHSHEMAEKEITDNMSNGGPQLIFNGRV

SEQ ID NO: 13391 - protein, 89 aa, Homo Sapiens
MILFSACCICGLIGGILNFQFLRAVTKKTSSLYPLHLASMSLACIGIGGCTLSSWLTCRLASYEQRRMFSEREHSLHHSHEMAEKIEGY

SEQ ID NO: 13392 - protein, 111 aa, Homo Sapiens
MILFSACCICGLIGGILNFQFLRAVTKKTSSLYPLHLASMSLACIGIGGCTLSSWLTCRLASYEQRRMFSEREHSLHHSHEMAEKRLRAIEITDLPSCPVVPPTPELPTRK

SEQ ID NO: 13393 - protein, 34 aa, Homo Sapiens
MASRVLAALIVASVVGLAELYVMVRAMEGELGEL

SEQ ID NO: 13394 - protein, 125 aa, Homo Sapiens
MASSLLAGERLVRALGPGGELEPERLPRKLRAELEAALGKKHKGGDSSSGPQRLVSFRLIRDLHQHLRERDSKLYLHELLEGSEIYLPEVVKPPRNPELVARLEKIKIQLANEEYKRITRNVTCQ

SEQ ID NO: 13395 - protein, 208 aa, Homo Sapiens
MASSLLAGERLVRALGPGGELEPERLPRKLRAELEAALGKKHKGGDSSSGPQRLVSFRLIRDLHQHLRERDSKLYLHELLEGSEIYLPEVVKPPRNPELVARLEKIKIQLANEEYKRITRNVTCQDTRHGGTLSDLGKQVRSLKALVITIFNFIVTVVAAFVCTYLGSQYIFTEMASRVLAALIVASVVGLAELYVMVRAMEGELGEL

SEQ ID NO: 13396 - protein, 89 aa, Homo Sapiens
MASSLLAGERLVRALGPGGELEPERLPRKLRAELEAALGKKHKGGDSSSGPQRLVSFRLIRDLHQHLRERGEPQSPVREPRTSCPAGED

SEQ ID NO: 13397 - protein, 124 aa, Homo Sapiens [sequence omitted]

SEQ ID NO: 13398 - protein, 88 aa, Homo Sapiens
MEEGGNLGGLIKMVHLLVLSGAWGMQMWVTFVSGFLLFRSLPRHTFGLVQSKLFPFYFHISMGCAFINLCILASQHAWAQLTFWEASQ

SEQ ID NO: 13399 - protein, 107 aa, Homo Sapiens
MEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWLE

SEQ ID NO: 13400 - protein, 170 aa, Homo Sapiens
MEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLG

SEQ ID NO: 13401 - protein, 189 aa, Homo Sapiens
MEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLGCVLSNGLCLAGLALEIRSL

SEQ ID NO: 13402 - protein, 189 aa, Homo Sapiens; identical to SEQ ID NO: 13401

SEQ ID NO: 13403 - protein, 189 aa, Homo Sapiens; identical to SEQ ID NO: 13401

SEQ ID NO: 13404 - protein, 189 aa, Homo Sapiens; identical to SEQ ID NO: 13401

SEQ ID NO: 13405 - protein, 189 aa, Homo Sapiens; identical to SEQ ID NO: 13401

SEQ ID NO: 13406 - protein, 189 aa, Homo Sapiens; identical to SEQ ID NO: 13401

SEQ ID NO: 13407 - protein, 189 aa, Homo Sapiens; identical to SEQ ID NO: 13401

SEQ ID NO: 13408 - protein, 189 aa, Homo Sapiens; identical to SEQ ID NO: 13401

SEQ ID NO: 13409 - protein, 120 aa, Homo Sapiens
MGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLGCVLSNGLCLAG

SEQ ID NO: 13410 - protein, 128 aa, Homo Sapiens
MGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLGCVLSNGLCLAGLALEIRSL

SEQ ID NO: 13411 - protein, 106 aa, Homo Sapiens
MQRLPAATRATLILSLAFASLHSACSAASSSNSSSLTAHHPDPGTLEQCLNVDFCPQAARCCRTGVDEYGWIAAAVGWSLWFLTLILLCVDKLMKLTPDEPKDLQA

SEQ ID NO: 13412 - protein, 83 aa, Homo Sapiens
MQRLPAATRATLILSLAFASLHSACSADVDFCPQAARCCRTGVDEYGWIAAAVGWSLWFLTLILLCVDKLMKLTPDEPKDLQA

SEQ ID NO: 13413 - protein, 107 aa, Homo Sapiens
MQRLPAATRATLILSLAFASLHSACSAEASSSNSSSLTAHHPDPGTLEQCLNVDFCPQAARCCRTGVDEYGWIAAAVGWSLWFLTLILLCVDKLMKLTPDEPKDLQA

SEQ ID NO: 13414 - protein, 105 aa, Homo Sapiens
MQRLPAATRATLILSLAFASLHSACSAEASSSNSSSLTAHHPDPGTLEQCLRSGYLANLRGEADQLWKFCTVLCFWESRRSSSRIALMREAEEWPGWRSSVELVG

SEQ ID NO: 13415 - protein, 49 aa, Homo Sapiens
MALPPGPAALRHTLLLLPALLSSAQYQPCLSPSQRPPAVFQVGGSWSHK

SEQ ID NO: 13416 - protein, 40 aa, Homo Sapiens
MALPPGPAALRHTLLLLPALLSSGGPGTPRLAWYLDGQLQ

SEQ ID NO: 13417 - protein, 170 aa, Homo Sapiens
MALPPGPAALRHTLLLLPALLSSGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSL

SEQ ID NO: 13418 - protein, 37 aa, Homo Sapiens
MALPPGPAALRHTLLLLPALLSSGPQKWPISQRLCHP

SEQ ID NO: 13419 - protein, 168 aa, Homo Sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQCPSRHPSLISSDSNNLKLNNVRLPRENMSLPSNLQLNDLTP

SEQ ID NO: 13420 - protein, 138 aa, Homo Sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAK

SEQ ID NO: 13421 - protein, 366 aa, Homo Sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 13422 - protein, 351 aa, Homo Sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRAVKPADRQMAQNNSRPELLDPEPGGLLTSQGRRNQDKDA

SEQ ID NO: 13423 - protein, 381 aa, Homo Sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRVKPADRQMAQNNSRPELLDPEPGGLLTSQACLLHHGTPALTNPWLPHQQEGALPGGWSPQAHNSTVWKL

SEQ ID NO: 13424 - protein, 322 aa, Homo Sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 13425 - protein, 306 aa, Homo Sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRVKPADRQMAQNNSRPELLDPEPGGLLTSQGRRNQDKDA

SEQ ID NO: 13426 - protein, 322 aa, Homo Sapiens; identical to SEQ ID NO: 13424

SEQ ID NO: 13427 - protein, 322 aa, Homo Sapiens; identical to SEQ ID NO: 13424

SEQ ID NO: 13428 - protein, 167 aa, Homo Sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQWLLATRVEVPLLGIVVAAGLALGTLVGFSTLVACLVCRKE

SEQ ID NO: 13429 - protein, 218 aa, Homo Sapiens
MALPPGPAALRHTLLLLPALLSSVKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 13430 - protein, 200 aa, Homo Sapiens
  misc_feature (1)..(1): Xaa can be any naturally occurring amino acid
XDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRVKPADRQMAQNNSRPELLDPEPGGLLTSQGFIRLPVLGYIYRVSSVSSDEIWL

SEQ ID NO: 13431 - protein, 195 aa, Homo Sapiens
  misc_feature (1)..(1): Xaa can be any naturally occurring amino acid
XLLRRRSGREPVKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRAVKPADRQMAQNNSRPELLDPEPGGLLTSQGFIRLPVLGYIYR

SEQ ID NO: 13432 - protein, 113 aa, Homo Sapiens
MEERAQHCLSRLLDNSALKQQELPIHRLYFTARRVLFVFFATGIFCLCMGIILILSARSTQEIEINYTRICANCAKLRENASNFDKECTCSIPFYLSGKMMVGEIQETRLTLH

SEQ ID NO: 13433 - protein, 291 aa, Homo Sapiens
MDSPWDELALAFSRTSMFPFFDIAHYLVSVMAVKRQPGAAALAWKNPISSWFTAMLHCFGGGILSCLLLAEPPLKFLANHTNILLASSIWYITFFCPHDLVSQGYSYLPVQLLASGMKEVTRTWKIVGGVTHANSYYKNGWIVMIAIGWARGAGGTIITNFERLVKGDWKPEGDEWLKMSYPAKVTLLGSVIFTFQHTQHLAISKHNLMFLYTIFIVATKITMMTTQTSTMTFAPFEDTLSWMLFGWQQPFSSCEKKSEAKSPSNGVGSLASKPVDVASDNVKKKHTKKNE

SEQ ID NO: 13434 - protein, 35 aa, Homo Sapiens
MLHCFGGGILSCLLLAEPPLKFLANHTNILLASSI

SEQ ID NO: 13435 - protein, 237 aa, Homo Sapiens
MLHCFGGGILSCLLLAEPPLKFLANHTNILLASSIWYITFFCPHDLVSQGYSYLPVQLLASGMKEVTRTWKIVGGVTHANSYYKNGWIVMIAIGWARGAGGTIITNFERLVKGDWKPEGDEWLKMSYPAKVTLLGSVIFTFQHTQHLAISKHNLMFLYTIFIVATKITMMTTQTSTMTFAPFEDTLSWMLFGWQQPFSSCEKKSEAKSPSNGVGSLASKPVDVASDNVKKKHTKKNE

SEQ ID NO: 13436 - protein, 162 aa, Homo Sapiens
  misc_feature (1)..(1): Xaa can be any naturally occurring amino acid
XSCLLLAEPPLKFLANHTNILLASSIWYITFFCPHDLVSQGYSYLPVQLLASGMKEVTRTWKIVGGVTHANSYYKNGWIVMIAIGWARGAGGTIITNFERLVKGDWKPEGDEWLKMSYPAKVTLLGSVIFTFQHTQHLAISKHNLMFLYTIFIVATKSLNWR

SEQ ID NO: 13437 - protein, 81 aa, Homo Sapiens
  misc_feature (1)..(1): Xaa can be any naturally occurring amino acid
XWIVMIAIGWARGAGGTIITNFERLVKGDWKPEGDEWLKMSYPAKVTLLGSVIFTFQHTQHLAISKHNLMFLYTIFIVATK

SEQ ID NO: 13438 - protein, 197 aa, Homo Sapiens
LRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEQKYWEALNSEQWDPEDVNLEGSKENVELLGSQVHQDSVRTAHLSDDD

SEQ ID NO: 13439 - protein, 150 aa, Homo Sapiens
MFILFPVCGSKFKSNSDREARERKRRRQLRASVFALALPLSLGPCWALWVAVPKASATIRGPQRRLLASLLQENTEILGYLLGSVAAFGSWASRIPPLSRIMESRCVAQAGVQWRDLGSLQPSPPNFKQFSCLSLPSSWDYSCQWSCRSC

SEQ ID NO: 13440 - protein, 113 aa, Homo Sapiens
MFILFPVCGSKFKSNSDREARERKRRRQLRASVFALALPLSLGPCWALWVAVPKASATIRGPQRRLLASLLQENTEILGYLLGSVAAFGSWASRIPPLSRIVRPGVGMGLWVT

SEQ ID NO: 13441 - protein, 121 aa, Homo Sapiens
MGEAPSPAPALWDWDYLDRCFARHRVCISFGLWICASSCWIAAHALLLYLRCAQKPRQDQSALCAACCLLTSLCDTVGALLARQLTIQSVDPNSSLIQIGKPERGRGGGSSGPVCLPWPCR

SEQ ID NO: 13442 - protein, 475 aa, Homo Sapiens
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRIAPPPTLGITTQHEIWRGQMSKPSQSPSRSPSGHWRAAAQRQVLGTEMCRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 13443 - protein, 428 aa, Homo Sapiens
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRICRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 13444 - protein, 396 aa, Homo Sapiens
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRICRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAAVPPGCQVTGRRAPEMRPCRTPRRTLPFRSSGPGCLPAAPLRSPPSTPTWSGTLKM

SEQ ID NO: 13445 - protein, 438 aa, Homo Sapiens
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRICRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEKYWEALNSEQWDPEDVNLEGSKENVELLGSQVHQDSVRTAHLSDDD

SEQ ID NO: 13446 - protein, 119 aa, Homo Sapiens
MKSKMRQALGFAKEARESPDTQALLTCAEKEEENQENLDWVPLTTLSHCKSLRTMTAISRYMELTIEPVQQAAVPPGCQVTGRRAPEMRPCRTPRRTLPFRSSGPGCLPAAPLSGTLKM

SEQ ID NO: 13447 - protein, 261 aa, Homo Sapiens
NFMFILFPVCGSKFKSNSDREARERKRRRQLRASVFALALPLSLGPCWALWVAVPKASATIRGPQRRLLASLLQENTEILGYLLGSVAAFGSWASRIPPLSRISKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 13448 - protein, 124 aa, Homo Sapiens
GGRWPPADCGCCCRSCRSCRSCRCRRWVGRRSLSVRPPRGGSLLGPRPSRAHPCPHRWRWASRTAAATPRTSARPRPAGAACGTWACTPRSLHPPTMKLSRWPSPERKDQHSPRNPALSLGPRA

SEQ ID NO: 13449 - protein, 43 aa, Homo Sapiens
MARGPLAARGLRLLLPLLPLLPLLPLPQVALGFADGSCDPSDQ

SEQ ID NO: 13450 - protein, 209 aa, Homo Sapiens
MARGPLAARGLRLLLPLLPLLPLLPLPQVALGFADGSCDPSDQCPPQARWSSLWHVGLILLAVLLLLLCGVTAGCVRFCCLRKQAQAQPHLPPARQPCDVAVIPMDSDSPVHSTVTSYSSVQYPLGMRLPLPFGELDLDSMAPPAYSLYTPEPPPSYDEAVKMAKPREEGPALSQKPSPLLGASGLETTPVPQESGPNTQLPPCSPGAP

SEQ ID NO: 13451 - protein, 103 aa, Homo Sapiens
MARGPLAARGLRLLLPLLPLLPLLPLPQVGRAAFSLGSATAGRVPARTTPLPGSPLSPQVALGFADGSCDPSDQCPPQARWSSLWHVGLILLAVLLLLLCGVT

SEQ ID NO: 13452 - protein, 194 aa, Homo Sapiens
MERHCLLFILLTCLRWLCHDIPQGAGARWPRVSPVVEPCSPRLILLAVLLLLLCGVTAGCVRFCCLRKQAQAQPHLPPARQPCDVAVIPMDSDSPVHSTVTSYSSVQYPLGMRLPLPFGELDLDSMAPPAYSLYTPEPPPSYDEAVKMAKPREEGPALSQKPSPLLGASGLETTPVPQESGPNTQLPPCSPGAP

SEQ ID NO: 13453 - protein, 90 aa, Homo Sapiens
MGVRVHVVAASALLYFILLSGTRCEENCGNPEHCLTTDWVHLWYIWLLVVIGALLLLCGLTSLCFRCCCLSRQQNGEDGGPPPCEVTVIA

SEQ ID NO: 13454 - protein, 183 aa, Homo Sapiens
MGVRVHVVAASALLYFILLSGTRCEENCGNPEHCLTTDWVHLWYIWLLVVIGALLLLCGLTSLCFRCCCLSRQQNGEDGGPPPCEVTVIAFDHDSTLQSTITSLQSVFGPAARRILAVAHSHSSLGQLPSSLDTLPGYEEALHMSRFTVAMCGQKAPDLPPVPEEKQLPPTEKESTRIVDSWN

SEQ ID NO: 13455 - protein, 163 aa, Homo Sapiens
MSWRPQPCCISSCCLTTDWVHLWYIWLLVVIGALLLLCGLTSLCFRCCCLSRQQNGEDGGPPPCEVTVIAFDHDSTLQSTITSLQSVFGPAARRILAVAHSHSSLGQLPSSLDTLPGYEEALHMSRFTVAMCGQKAPDLPPVPEEKQLPPTEKESTRIVDSWN

SEQ ID NO: 13456 - protein, 323 aa, Homo Sapiens
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEKLSIYGDLEFMNEQKLNRYPASSLVVVRSKTEDHEEAGPLPTKVNLAHSEI

SEQ ID NO: 13457 - protein, 145 aa, Homo Sapiens
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQVRNNTAFQTSLLRWH

SEQ ID NO: 13458 - protein, 285 aa, Homo Sapiens
MAAPKGSLWVRTQLGLPPLLLLTMALAGGSGTASAEAFDSVLGDTASCHRACQLTYPLHTYPKVSASLYTVDHIEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEVN

SEQ ID NO: 13459 - protein, 192 aa, Homo Sapiens
MSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEKLSIYGDLEFMNEQKLNRYPASSLVVVRSKTEDHEEAGPLPTKVNLAHSEI

SEQ ID NO: 13460 - protein, 192 aa, Homo Sapiens; identical to SEQ ID NO: 13459

SEQ ID NO: 13461 - protein, 192 aa, Homo Sapiens; identical to SEQ ID NO: 13459

SEQ ID NO: 13462 - protein, 144 aa, Homo Sapiens
MSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEVNL

SEQ ID NO: 13463 - protein, 144 aa, Homo Sapiens; identical to SEQ ID NO: 13462

SEQ ID NO: 13464 - protein, 180 aa, Homo Sapiens
MATRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMKGVTEDGWNCISCPSDLTAEGKCHCPIGHILDSNSGKWLLTRRIFLVDAVSGRENDLGTQPRVIRVATQISLSVHL

SEQ ID NO: 13465 - protein, 147 aa, Homo Sapiens
MATRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMKGVTEDGWNCISCPSDLTAEGKCHCPIGHILGSHSCPGWSVVV

SEQ ID NO: 13466 - protein, 995 aa, Homo Sapiens
MATRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMKGVTEDGWNCISCPSDLTAEGKCHCPIGHILVERDINGTLLSQATCELCDGNENSFMVVNALGDRCVRCEPTFVNTSRSCACSEPNILTGGLCFSSTGNFPLRRISAARYGEVGMSLTSEWFAKYLQSSAAACWVYANLTSCQALGNMCVMNMNSYDFATFDACGLFQFIFENTAGLSTVHSISFWRQNLPWLFYGDQLGLAPQVLSSTSLPTNFSFKGENQNTKLKFVAASYDIRGNFLKWQTLEGGVLQLCPDTETRLNAAYSFGTTYQQNCEIPISKILIDFPTPIFYDVYLEYTDENQHQYILAVPVLNLNLQHNKIFVNQDSNSGKWLLTRRIFLVDAVSGRENDLGTQPRVIRVATQISLSVHLVPNTINGNIYPPLITIAYSDIDIKDANSQSVKVSFSVTYEMDHGEAHVQTDIALGVLGGLAVLASLLKTAGWKRRIGSPMIDLQTVVKFLVYYAGDLANVFFIITVGTGLYWLIFFKAQKSVSVLLPMPIQEERFVTYVGCAFALKALQFLHKLISQITIDVFFIDWERPKGKVLKAVEGEGGVRSATVPVSIWRTYFVANEWNEIQTVRKINSLFQVLTVLFFLEVVGFKNLALMDSSSSLSRNPPSYIAPYSCILRYAVSAALWLAIGIIQVVFFAVFYERFIEDKIRQFVDLCSMSNISVFLLSHKCFGYYIHGRSVHGHADTNMEEMNMNLKREAENLCSQRGLVPNTDGQTFEIAISNQMRQHYDRIHETLIRKNGPARLLSSSASTFEQSIKAYHMMNKFLGSFIDHVHKEMDYFIKDKLLLERILGMEFMEPMEKSIFYNDEGYSFSSVLYYGNEATLLIFDLLFFCVVDLACQNFILASFLTYLQQEIFRYIRNTVGQKNLASKTLVDQRFLI

SEQ ID NO: 13467 - protein, 119 aa, Homo Sapiens
MATRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMVLQKMAGTAFLALVT

SEQ ID NO: 13468 - protein, 985 aa, Homo Sapiens
MAVWSLLSARAVTAFLLLFLPRFLQAQTFSFPFQQPEKCDNNQYFDISALSCVPCGANQRQDARGTSCVCLPGFQMISNNGGPAIICKKCPENMKGVTEDGWNCISCPSDLTAEGKCHCPIGHILVERDINGTLLSQATCELCDGNENSFMVVNALGDRCVRCEPTFVNTSRSCACSEPNILTGGLCFSSTGNFPLRRISAARYGEVGMSLTSEWFAKYLQSSAAACWVYANLTSCQALGNMCVMNMNSYDFATFDACGLFQFIFENTAGLSTVHSISFWRQNLPWLFYGDQLGLAPQVLSSTSLPTNFSFKGENQNTKLKFVAASYDIRGNFLKWQTLEGGVLQLCPDTETRLNAAYSFGTTYQQNCEIPISKILIDFPTPIFYDVYLEYTDENQHQYILAVPVLNLNLQHNKIFVNQDSNSGKWLLTRRIFLVDAVSGRENDLGTQPRVIRVATQISLSVHLVPNTINGNIYPPLITIAYSDIDIKDANSQSVKVSFSVTYEMDHGEAHVQTDIALGVLGGLAVLASLLKTAGWKRRIGSPMIDLQTVVKFLVYYAGDLANVFFIITVGTGLYWLIFFKAQKSVSVLLPMPIQEERFVTYVGCAFALKALQFLHKLISQITIDVFFIDWERPKGKVLKAVEGEGGVRSATVPVSIWRTYFVANEWNEIQTVRKINSLFQVLTVLFFLEVVGFKNLALMDSSSSLSRNPPSYIAPYSCILRYAVSAALWLAIGIIQVVFFAVFYERFIEDKIRQFVDLCSMSNISVFLLSHKCFGYYIHGRSVHGHADTNMEEMNMNLKREAENLCSQRGLVPNTDGQTFEIAISNQMRQHYDRIHETLIRKNGPARLLSSSASTFEQSIKAYHMMNKFLGSFIDHVHKEMDYFIKDKLLLERILGMEFMEPMEKSIFYNDEGYSFSSVLYYGNEATLLIFDLLFFCVVDLACQNFILASFLTYLQQEIFRYIRNTVGQKNLASKTLVDQRFLI

SEQ ID NO: 13469 - protein, 397 aa, Homo Sapiens
MKGVTEDGWNCISCPSDLTAEGKCHCPIGHILVERDINGTLLSQATCELCDGNENSFMVVNALGDRCVRCEPTFVNTSRSCACSEPNILTGGLCFSSTGNFPLRRISAARYGEVGMSLTSEWFAKYLQSSAAACWVYANLTSCQALGNMCVMNMNSYDFATFDACGLFQFIFENTAGLSTVHSISFWRQNLPWLFYGDQLGLAPQVLSSTSLPTNFSFKGENQNTKLKFVAASYDIRGNFLKWQTLEGGVLQLCPDTETRLNAAYSFGTTYQQNCEIPISKILIDFPTPIFYDVYLEYTDENQHQYILAVPVLNLNLQHNKIFVNQDSNSGKWLLTRRIFLVDAVSGRENDLGTQPRVIRVATQISLSVHLVPNTINGNIYPPLITIAYSDIDIKDA

SEQ ID NO: 13470 - protein, 914 aa, Homo Sapiens
MSLSHWPYFRLVLNFRPQVICLPQPPKVLGYRLEPPHLTLACTLEGMYNIIEEILERDINGTLLSQATCELCDGNENSFMVVNALGDRCVRCEPTFVNTSRSCACSEPNILTGGLCFSSTGNFPLRRISAARYGEVGMSLTSEWFAKYLQSSAAACWVYANLTSCQALGNMCVMNMNSYDFATFDACGLFQFIFENTAGLSTVHSISFWRQNLPWLFYGDQLGLAPQVLSSTSLPTNFSFKGENQNTKLKFVAASYDIRGNFLKWQTLEGGVLQLCPDTETRLNAAYSFGTTYQQNCEIPISKILIDFPTPIFYDVYLEYTDENQHQYILAVPVLNLNLQHNKIFVNQDSNSGKWLLTRRIFLVDAVSGRENDLGTQPRVIRVATQISLSVHLVPNTINGNIYPPLITIAYSDIDIKDANSQSVKVSFSVTYEMDHGEAHVQTDIALGVLGGLAVLASLLKTAGWKRRIGSPMIDLQTVVKFLVYYAGDLANVFFIITVGTGLYWLIFFKAQKSVSVLLPMPIQEERFVTYVGCAFALKALQFLHKLISQITIDVFFIDWERPKGKVLKAVEGEGGVRSATVPVSIWRTYFVANEWNEIQTVRKINSLFQVLTVLFFLEVVGFKNLALMDSSSSLSRNPPSYIAPYSCILRYAVSAALWLAIGIIQVVFFAVFYERFIEDKIRQFVDLCSMSNISVFLLSHKCFGYYIHGRSVHGHADTNMEEMNMNLKREAENLCSQRGLVPNTDGQTFEIAISNQMRQHYDRIHETLIRKNGPARLLSSSASTFEQSIKAYHMMNKFLGSFIDHVHKEMDYFIKDKLLLERILGMEFMEPMEKSIFYNDEGYSFSSVLYYGNEATLLIFDLLFFCVVDLACQNFILASFLTYLQQEIFRYIRNTVGQKNLASKTLVDQRFLI

SEQ ID NO: 13471 - protein, 6 aa, Homo Sapiens
MVVNAL

SEQ ID NO: 13472 - protein, 38 aa, Homo Sapiens
MVVNALGDRCVRCEPTFVNTSRSCACSEPNILTGGLCF

SEQ ID NO: 13473 - protein, 239 aa, Homo Sapiens
  misc_feature (1)..(1): Xaa can be any naturally occurring amino acid
XFYDVYLEYTDENQHQYILAVPVLNLNLQHNKIFVNQDSNSGKWLLTRRIFLVDAVSGRENDLGTQPRVIRVATQISLSVHLVPNTINGNIYPPLITIAYSDIDIKDANSQSVKVSFSVTYEMDHGEAHVQTDTEFCTCCPGWSAMARSWLTATSASRVQAILLSQPPEYLGLQIALGVLGGLAVLASLLKTAGWKRRIGSPMIDLQTVVKFLVYYAGDLANVFFIITVGTGLYWLIFF

SEQ ID NO: 13474 - protein, 173 aa, Homo Sapiens
  misc_feature (1)..(1): Xaa can be any naturally occurring amino acid
XRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMKGVTEDGWNCISCPSDLTAEGKCHCPIGHILVERDINGTLLSQATCELCDGNENSFMVVNALGDRQGDYVS

SEQ ID NO: 13475 - protein, 87 aa, Homo Sapiens
  misc_feature (1)..(1): Xaa can be any naturally occurring amino acid
XTRGGAGVAMAVWSLLSARAVTAFLLLFLPRFLQAQTFSFPFQQPEKCDNNQYFDISALSCVPCGANQRQDARERCYRRWLELHFLP

SEQ ID NO: 13476 - protein, 107 aa, Homo Sapiens
MLFLALGSPWAVELPLCGRRTALCAAAALRGPRASVSRASSSSGPSGPVAGWSTGPSGAARLLRRPGRAQIPVYWEGYVRFLNTPSDKSEDGRLIYTGNMARAVFGK

SEQ ID NO: 13477 - protein, 260 aa, Homo Sapiens
MLFLALGSPWAVELPLCGRRTALCAAAALRGPRASVSRASSSSGPSGPVAGWSTGPSGAARLLRRPGRAQIPVYWEGYVRFLNTPSDKSEDGRLIYTGNMARAVFGVKCFSYSTSLIGLTFLPYIFTQNNAISESVPLPIQIIFYGIMGSFTVITPVLLHFITKGYVIRLYHEATTDTYKAITYNAMLAETSTVFHQNDVKIPDAKHVFTTFYAKTKSLLVNPVLFPNREDYIHLMGYDKEEFILYMEETSEEKRHKDDK

SEQ ID NO: 13478 - protein, 111 aa, Homo Sapiens
MLFLALGSPWAVELPLCGRRTALCAAAALRGPRASVSRASSSSGPSGPVAGWSTGPSGAARLLRRPGRAQIPVYWEGYVRFLNTPSDKSEDGRLIYTGNMARAVFGWSAVA

SEQ ID NO: 13479 - protein, 555 aa, Homo Sapiens
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 13480 - protein, 181 aa, Homo Sapiens
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTIQMPFLKKHFLDC

SEQ ID NO: 13481 - protein, 57 aa, Homo Sapiens
MAAAAWLQVLPVILLLLGAHPSPLSFFSAGPATVAAADRSKWHIPIPSLMENLVTCL

SEQ ID NO: 13482 - protein, 494 aa, Homo Sapiens
MAHSDTVVDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 13483 - protein, 39 aa, Homo Sapiens
MHRLPLLGEKQEAKENGTNLTFIGDKTAMHEPLQTWQDA

SEQ ID NO: 13484 - protein, 110 aa, Homo Sapiens
MHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACY

SEQ ID NO: 13485 - protein, 170 aa, Homo Sapiens
MHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTL

SEQ ID NO: 13486 - protein, 88 aa, Homo Sapiens [sequence omitted]

SEQ ID NO: 13487 - protein, 40 aa, Homo Sapiens
MHRLPLLGEKQEAKENGTNLTFIGDKTIQMPFLKKHFLDC

SEQ ID NO: 13488 - protein, 195 aa, Homo Sapiens
  misc_feature (1)..(1): Xaa can be any naturally occurring amino acid
XFYAEFQNIRYKGESVQGALILAELLSAVKRSLARTLVIIVSLGYGIVKPRLGVTLHKVVVAGALYLLFSGMEGVLRVTGYFSYPLTLIVNLALSAIDACVILWIFISLTQTMKLLKLRRNIVKLSLYRHFTNTLILAVAASIVFIIWTTMKFRIVTCQSDWRELWVDDAIWRLLFSMILFVIMVLWRPSANNQR

SEQ ID NO: 13489 - protein, 256 aa, Homo Sapiens
EMLRCIWGHFLRVLGGTSPTLSHSSSLLHSLGSVTVLCCVDKQGILSWPNPSPETVLFFSGKVEPPHSSHEDLTDGLSTRSFCHPEVEEEPHERDALLAGSLNNTLHLSNEQERGDWPGEAPKPPEPYSHHKAHGRSKHPSGSNVSFSRDTEGGEEEPSKTQPGMESDPYEAEDFVCDYHLEMLSLSQDQQNPSCIQFDDSNWQLHLTSLKPLGLNVLLNLCDASVTERLCRFSDHLCNIALQESHSAVLPVHVPW

SEQ ID NO: 13490 - protein, 57 aa, Homo Sapiens
MDLKEKHLGEPPSALGLSTRKALSVLKEQLEAVLEGHLRERKKCLTWKEVWRSSFLH

SEQ ID NO: 13491 - protein, 121 aa, Homo Sapiens
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKR

SEQ ID NO: 13492 - protein, 125 aa, Homo Sapiens
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVE

SEQ ID NO: 13493 - protein, 1356 aa, Homo Sapiens
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGIKDDEHIVLEPGDLFPPFSPPPSPRGEVERGPQSPQQHRLFRVLETPVIDNIRWCLDMALSRPVTALDNERFTVQSVMLHYAVPVVLAGFLITNALRFIFSAPGVTSWQYTLLQLQVNGVLPILPLLFPVLWVLATACGEARVLAQMSKASPSSLLAKFSEDTLSSYTEAVSSQEMLRCIWGHFLRVLGGTSPTLSHSSSLLHSLGSVTVLCCVDKQGILSWPNPSPETVLFFSGKVEPPHSSHEDLTDGLSTRSFCHPEPHERDALLAGSLNNTLHLSNEQERGDWPGEAPKPPEPYSHHKAHGRSKHPSGSNVSFSRDTEGGEEEPSKTQPGMESDPYEAEDFVCDYHLEMLSLSQDQQNPSCIQFDDSNWQLHLTSLKPLGLNVLLNLCDASVTERLCRFSDHLCNIALQESHSAVLPVHVPWGLCELARLIGFTPGAKELFKQENHLALYRLPSAETMKETSLGRLSCVTKRRPPLSHMISLFIKDTTTSTEQMLSHGTADVVLEACTDFWDGADIYPLSGSDRKKVLDFYQRACLSGYCSAFAYKPMNCALSSQLNGKCIELVQVPGQSSIFTMCELPSTIPIKQNARRSSWSSDEGIGEVLEKEDCMQALSGQIFMGMVSSQYQARLDIVRLIDGLVNACIRFVYFSLEDELKSKVFAEKMGLETGWNCHISLTPNGDMPGSEIPPSSPSHAGSLHDDLNQVSRDDAEGLLLMEEEGHSDLISFQPTDSDIPSFLEDSNRAKLPRGIHQVRPHLQNIDNVPLLVPLFTDCTPETMCEMIKIMQEYGEVTCCLGSSANLRNSCLFLQSDISIALDPLYPSRCSWETFGYATSISMAQASDGLSPLQLSGQLNSLPCSLTFRQEETISIIRLIEQARHATYGIRKCFLFLLQCQLTLVVIQFLSCLVQLPPLLSTTDILWLSCFCYPLLSISLLGKPPHSSIMSMATGKNLQSIPKKTQHYFLLCFLLKFSLTISSCLICFGFTLQSFCDSSRDRNLTNCSSVMLPSNDDRAPAWFEDFANGLLSAQKLTAALIVLHTVFISITHVHRTKPLWRKSPLTNLWWAVTVPVVLLGQVVQTAVDLQLWTHRDSHVHFGLEDVPLLTWLLGCLSLVLVVVTNEIVKLHEIRVRVRYQKRQKLQFETKLGMNSPF

SEQ ID NO: 13494 - protein, 1007 aa, Homo Sapiens [sequence omitted]

SEQ ID NO: 13495 - protein, 162 aa, Homo Sapiens
MLFKQAELWMPHQGKGNKGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQASSLPPHSDAETTHQS

SEQ ID NO: 13496 - protein, 1366 aa, Homo Sapiens
MLFKQAELWMPHQGKGNKGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGIKDDEHIVLEPGDLFPPFSPPPSPRGEVERGPQSPQQHRLFRVLETPVIDNIRWCLDMALSRPVTALDNERFTVQSVMLHYAVPVVLAGFLITNALRFIFSAPGVTSWQYTLLQLQVNGVLPILPLLFPVLWVLATACGEARVLAQMSKASPSSLLAKFSEDTLSSYTEAVSSQEMLRCIWGHFLRVLGGTSPTLSHSSSLLHSLGSVTVLCCVDKQGILSWPNPSPETVLFFSGKVEPPHSSHEDLTDGLSTRSFCHPEPHERDALLAGSLNNTLHLSNEQERGDWPGEAPKPPEPYSHHKAHGRSKHPSGSNVSFSRDTEGGEEEPSKTQPGMESDPYEAEDFVCDYHLEMLSLSQDQQNPSCIQFDDSNWQLHLTSLKPLGLNVLLNLCDASVTERLCRFSDHLCNIALQESHSAVLPVHVPWGLCELARLIGFTPGAKELFKQENHLALYRLPSAETMKETSLGRLSCVTKRRPPLSHMISLFIKDTTTSTEQMLSHGTADVVLEACTDFWDGADIYPLSGSDRKKVLDFYQRACLSGYCSAFAYKPMNCALSSQLNGKCIELVQVPGQSSIFTMCELPSTIPIKQNARRSSWSSDEGIGEVLEKEDCMQALSGQIFMGMVSSQYQARLDIVRLIDGLVNACIRFVYFSLEDELKSKVFAEKMGLETGWNCHISLTPNGDMPGSEIPPSSPSHAGSLHDDLNQVSRDDAEGLLLMEEEGHSDLISFQPTDSDIPSFLEDSNRAKLPRGIHQVRPHLQNIDNVPLLVPLFTDCTPETMCEMIKIMQEYGEVTCCLGSSANLRNSCLFLQSDISIALDPLYPSRCSWETFGYATSISMAQASDGLSPLQLSGQLNSLPCSLTFRQEETISIIRLIEQARHATYGIRKCFLFLLQCQLTLVVIQFLSCLVQLPPLLSTTDILWLSCFCYPLLSISLLGKPPHSSIMSMATGKNLQSIPKKTQHYFLLCFLLKFSLTISSCLICFGFTLQSFCDSSRDRNLTNCSSVMLPSNDDRAPAWFEDFANGLLSAQKLTAALIVLHTVFISITHVHRTKPLWRKSPLTNLWWAVTVPVVLLGQVVQTAVDLQLWTHRDSHVHFGLEDVPLLTWLLGCLSLVLVVVTNEIVKLHEIRVRVRYQKRQKLQFETKLGMNSPF

SEQ ID NO: 13497 - protein, 35 aa, Homo Sapiens
MLLAVLLLLGCCGGQPAGSRGVGLVNASALFLLLL

SEQ ID NO: 13498 - protein, 89 aa, Homo Sapiens
MSKASPSSLLAKFSEDTLSSYTEAVSSQEMLRCIWGHFLRVLGGTSPTLSHSSSLLHSLGSVTVLCCVDKQGILSWPNPSPETVLFFSG

SEQ ID NO: 13499 - protein, 128 aa, Homo Sapiens
PHSSIMSMATGKNLQSIPKKTQHYFLLCFLLKFSLTISSCLICFGFTLQSFCDSSRDRNLTNCSSVMLPRAPAWFEDFANGLLSAQKLTAALIVLHTVFISITHVHRTKPLWRKSPLTNLWWAVTVPV

SEQ ID NO: 13500 - protein, 302 aa, Homo Sapiens
  misc_feature (1)..(1): Xaa can be any naturally occurring amino acid
XGKVEPPHSSHEDLTDGLSTRSFCHPEPHERDALLAGSLNNTLHLSNEQERGDWPGEAPKPPEPYSHHKAHGRSKHPSGSNTQPGMESDPYEAEDFVCDYHLEMLSLSQDQQNPSCIQFDDSNWQLHLTSLKPLGLNVLLNLCDASVTERLCRFSDHLCNIALQESHSAVLPVHVPWGLCELARLIGFTPGAKELFKQENHLALYRLPSAETMKETSLGRLSCVTKRRPPLSHMISLFIKDTTTSTEQMLSHGTADVVLEACTDFWDGADIYPLSGSDRKKVLDFYQRACLSGYCSAFAYKP

SEQ ID NO: 13501 - protein, 56 aa, Homo Sapiens
  misc_feature (1)..(1): Xaa can be any naturally occurring amino acid
XLLLNLVLIGRQDRLKRREVERRLRGIIDQIQDGAWTWPCPDQSLPWTMSGSQCSR

SEQ ID NO: 13502 - protein, 73 aa, Homo Sapiens
  misc_feature (1)..(1): Xaa can be any naturally occurring amino acid
XRDALLAGSLNNTLHLSNEQERGDWPGEAPKPPEPYSHHKAHGRSKHPSGSNVSFSRDTEGGEEEPSKLLPVS

SEQ ID NO: 13503 - protein, 176 aa, Homo Sapiens
  misc_feature (1)..(1): Xaa can be any naturally occurring amino acid
XWLSCFCYPLLSISLLGKPPHSSIMSMATGKNLQSIPKKSFCDSSRDRNLTNCSSVMLPSNDDRAPAWFEDFANGLLSAQKLTAALIVLHTVFISITHVHRTKPLWRKSPLTNLWWAVTVPVVLLGQVVQTAVDLQLWTHRDSHVHFGLEDVPLLTWLLGCLSLVLVVVTNEIVKL

SEQ ID NO: 13504 - protein, 295 aa, Homo Sapiens
YATSISMAQASDGLSPLQLSGQLNSLPCSLTFRQEETISIIRLIEQFLSCLVQLPPLLSTTDILWLSCFCYPLLSISLLGKPPHSSIMSMATGKNLQSIPKKTQHYFLLCFLLKFSLTISSCLICFGFTLQSFCDSSRDRNLTNCSSVMLPSNDDRAPAWFEDFANGLLSAQKLTAALIVLHTVFISITHVHRTKPLWRKSPLTNLWWAVTVPVVLLGQVVQTAVDLQLWTHRDSHVHFGLEDVPLLTWLLGCLSLVLVVVTNEIVKLHEIRVRVRYQKRQKLQFETKLGMNSPF

SEQ ID NO: 13505 - protein, 184 aa, Homo Sapiens
MWRLALGGVFLAAAQACVFCRLPAHDLSGRLARLCSQMEARQKECGASPDFSAFALDEVSMNKVTEKTHRVLRVMEIKEAVSSLPSYWSWLRKTKLPEYTREALCPPACPLPLLSPAGGSTTLYNCSTCKGTEVSCWPRKRCFPGSQDLWEAKILLLSIFGAFLLLGVLSLLVESHHLQAKSGL

SEQ ID NO: 13506 - protein, 203 aa, Homo Sapiens
MWRLALGGVFLAAAQACVFCRLPAHDLSGRLARLCSQMEARQKECGASPDFSAFALDEVSMNKVTEKTHRVLRVMEIKEAVSSLPSYWSWLRKTKLPEYTREALCPPACRGSTTLYNCSTCKGTEVSCWPRKRCFPGSLGSQDSAPLHLRSFPASGCSEPPGGVPPPPSKKWLVKTLKTSQPPALRGMHSQLPHPLEGNQSAP

SEQ ID NO: 13507 - protein, 176 aa, Homo Sapiens
MWRLALGGVFLAAAQACVFCRLPAHDLSGRLARLCSQMEARQKECGASPDFSAFALDEVSMNKVTEKTHRVLRVMEIKEAVSSLPSYWSWLRKTKLPEYTREALCPPACRGSTTLYNCSTCKGTEVSCWPRKRCFPGSQDLWEAKILLLSIFGAFLLLGVLSLLVESHHLQAKSGL

SEQ ID NO: 13508 - protein, 218 aa, Homo Sapiens
MAWKSSVIMQMGRFLLLVILFLPREMTSSVLTVNGKTENYILDTTPGSQASLICAVQNHTREEELLWYREEGRVDLKSGNKINSSSVCVSSISENDNGISFTCRLGRDQSVSVSVVLNVTFPPLLSGNDFQTVEEGSNVKLVCNVKANPQAQMMWYKNSSLLDLEKSRHQIQQTSESFQLSITKVEKPDNGTYSCIAKSSLKTESLDFHLIVKALHEG

SEQ ID NO: 13509 - protein, 262 aa, Homo Sapiens
MAWKSSVIMQMGRFLLLVILFLPREMTSSVLTVNGKTENYILDTTPGSQASLICAVQNHTREEELLWYREEGRVDLKSGNKINSSSVCVSSISENDNGISFTCRLGRDQSVSVSVVLNVTFPPLLSGNDFQTVEEGSNVKLVCNVKANPQAQMMWYKNSSLLDLEKSRHQIQQTSESFQLSITKVEKPDNGTYSCIAKSSLKTESLDFHLIVKDKTVGVPIEPIIAACVVIFLTLCFGLIARRKKIMKLCMKDKDPHSETAL

SEQ ID NO: 13510 - protein, 348 aa, Homo Sapiens
MRLGLLSVALLFVGSSHLYSDHYSPSGRHRLGPSPEPAASSQQAEAVRKRLRRRREGGAHAEDCGTAPLKDVLQGSRIIGGTEAQAGAWPWVVSLQIKYGRVLVHVCGGTLVRERWVLTAAHCTKDASDPLMWTAVIGTNNIHGRYPHTKKIKIKAIIIHPNFILESYVNDIALFHLKKAVRYNDYIQPICLPFDVFQILDGNTKCFISGWGRTKEEGNATNILQDAEVHYISREMCNSERSYGGIIPNTSFCAGDEDGAFDTCRGDSGGPLMCYLPEYKRFFVMGITSYGHGCGRRGFPGVYIGPSFYQKWLTEHFFHASTQGILTINILRGQILIALCFVILLATT

SEQ ID NO: 13511 - protein, 320 aa, Homo Sapiens
MRLGLLSVALLFVGSSHLYSDHYSPSGRHRLGPSPEPAASSQQAEAVRKRLRRRREGGAHAEDCGTAPLKDVLQGSRIIGGTEAQAGAWPWVVSLQIKYGRVLVHVCGGTLVRERWVLTAAHCTKDASDPLMWTAVIGTNNIHGRYPHTKKIKIKAIIIHPNFILESYVNDIALFHLKKAVRYNDYIQPICLPFDVFQILDGNTKCFISGWGRTKEEGNATNILQDAEVHYISREMCNSERSYGGIIPNTSFCAGDEDGAFDTCRVRPSNFPLKYFLKPEGNLSNKAFDNFLVVLIIRPKNNKSFFLLFNYFNNPNLLGS

SEQ ID NO: 13512 - protein, 10 aa, Homo Sapiens
MHSFRLARLS

SEQ ID NO: 13513 - protein, 17 aa, Homo Sapiens
MHSFRLARLSSWRVHAG

SEQ ID NO: 13514 - protein, 147 aa, Homo Sapiens
MHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQDSLL

SEQ ID NO: 13515 - protein, 198 aa, Homo Sapiens
MHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 13516 - protein, 413 aa, Homo Sapiens
MRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPRNNCTSGQVVSLRCSECGARPLASRIVGGQSVAPGRWPWQASVALGFRHTCGGSVLAPRWVVTAAHCMHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 13517 - protein, 344 aa, Homo Sapiens
MRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 13518 - protein, 457 aa, Homo Sapiens
MSLMLDDQPPMEAQYAEEGPGPGIFRAEPGDQQHPISQAVCWRSMRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPRNNCTSGQVVSLRCSECGARPLASRIVGGQSVAPGRWPWQASVALGFRHTCGGSVLAPRWVVTAAHCMHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 13519 - protein, 457 aa, Homo Sapiens; identical to SEQ ID NO: 13518

SEQ ID NO: 13520 - protein, 388 aa, Homo Sapiens
MSLMLDDQPPMEAQYAEEGPGPGIFRAEPGDQQHPISQAVCWRSMRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 13521 - protein, 44 aa, Homo Sapiens
MSLMLDDQPPMEAQYAEEGPGPGIFRAEPGDQQHPSRPDWAIGE

SEQ ID NO: 13522 - protein, 44 aa, Homo Sapiens; identical to SEQ ID NO: 13521

SEQ ID NO: 13523 - protein, 448 aa, Homo Sapiens
MTGWGQWRAIILHSPDPPWGQPHMIDVSQAVCWRSMRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPRNNCTSGQVVSLRCSECGARPLASRIVGGQSVAPGRWPWQASVALGFRHTCGGSVLAPRWVVTAAHCMHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 13524 - protein, 152 aa, Homo Sapiens
MTLIEGVGDEVTVLFSVLACLLVLALAWVSTHTAEGGDPLPQPSGTPTPSQPSAAMAATDSMRGEAPGAETPSLRHRGQAAQPEPSTGFTATPPAPDSPQEPLVLRLKFLNDSEQVARAWPHDTIGSLKRTQFPGREQQVRLIYQGQLLGDD

SEQ ID NO: 13525 - protein, 171 aa, Homo Sapiens
MTLIEGVGDEVTVLFSVLACLLVLALAWVSTHTAEGGDPLPQPSGTPTPSQPSAAMAATDSMRGEAPGAETPSLRHRGQAAQPEPSTGFTATPPAPDSPQEPLVLRLKFLNDSEQVARAWPHDTIGSLKRTQFPGREQQVRLIYQGQLLGDDTQTLGSLHLPPNCVLHCHV

SEQ ID NO: 13526 - protein, 246 aa, Homo Sapiens
MTLIEGVGDEVTVLFSVLACLLVLALAWVSTHTAEGGDPLPQPSGTPTPSQPSAAMAATDSMRGEAPGAETPSLRHRGQAAQPEPSTGFTATPPAPDSPQEPLVLRLKFLNDSEQVARAWPHDTIGSLKRTQFPGREQQVRLIYQGQLLGDDTQTLGSLHLPPNCVLHCHVSTRVGPPNPPCPPGSEPGPSGLEIGSLLLPLLLLLLLLLWYCQIQYRPFFPLTATLGLAGFTLLLSLLAFAMYRP

SEQ ID NO: 13527 - protein, 246 aa, Homo Sapiens; identical to SEQ ID NO: 13526

SEQ ID NO: 13528 - protein, 246 aa, Homo Sapiens; identical to SEQ ID NO: 13526

SEQ ID NO: 13529 - protein, 246 aa, Homo Sapiens; identical to SEQ ID NO: 13526

SEQ ID NO: 13530 - protein, 246 aa, Homo Sapiens; identical to SEQ ID NO: 13526

SEQ ID NO: 13531 - protein, 296 aa, Homo Sapiens
MAVLAPLIALVYSVPRLSRWLAQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEENVIREFNLNELYQRAKKLSKAGDNIPEEQPVASTPTTVSDGENKKDK

SEQ ID NO: 13532 - protein, 258 aa, Homo Sapiens
MAVLAPLIALVYSVPRLSRWLAQPYYLLSALLSAAFLLVRKLPPLCHGLPTQREDGNPCDFDWREVEILMFLSAIVMMKNRRSMFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEENVIREFNLNELYQRAKKLSKAGDNIPEEQPVASTPTTVSDGENKKDK

SEQ ID NO: 13533 - protein, 115 aa, Homo Sapiens
MAVLAPLIALVYSVPRLSRWLAQPYYLLSALLSAAFLLVRKLPPLCHGLPTQREDGNPCDFDWREVEILMFLSAIVMMKNRRSMPHEEGQRMGYRSAQPSLTCDISVFQSLWSNI

SEQ ID NO: 13534 - protein, 115 aa, Homo Sapiens; identical to SEQ ID NO: 13533

SEQ ID NO: 13535 - protein, 103 aa, Homo Sapiens
MAVLAPLIALVYSVPRLSRWLAQPYYLLSALLSAAFLLVRKLPPLCHGLPTQREDGNPCDFDWREVEILMFLSAIVMMKNRRSRGTRTGQEGHLDCGVLCQLV

SEQ ID NO: 13536 - protein, 103 aa, Homo Sapiens; identical to SEQ ID NO: 13535

SEQ ID NO: 13537 - protein, 84 aa, Homo Sapiens
MAVLAPLIALVYSVPRLSRWLAQPYYLLSALLSAAFLLVRKLPPLCHGLPTQREDGNPCDFDWREVEILMFLSAIVMMKNRRSS

SEQ ID NO: 13538 - protein, 86 aa, Homo Sapiens
MAVLAPLIALVYSVPRLSRWLAQPYYLLSALLSAAFLLVRKLPPLCHGLPTQREDGNPCDFDWREVEILMFLSAIVMMKNRRSSTK

SEQ ID NO: 13539 - protein, 63 aa, Homo Sapiens
MAAWKSWTALRLCATVVVLDMVVCKGFVEDLDESFKENRNDDIWLVDALLQSLEFEVIQQLSY

SEQ ID NO: 13540 - protein, 89 aa, Homo Sapiens
MAAWKSWTALRLCATVVVLDMVVCKGFVEDLDESFKENRNDDIWLVDFYAPWCGHCKKLEPIWNEVGLEMKSIGSPVKVGKMDATSYSN

SEQ ID NO: 13541 - protein, 89 aa, Homo Sapiens; identical to SEQ ID NO: 13540

SEQ ID NO: 13542 - protein, 197 aa, Homo Sapiens
MAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLALIRPLPSQQMFEHMQKRHRVFFVYVGGESPLKEKYIDAASELIVYTYFFSASEEVVPEYVTLKEMPAVLVFKDETYFVYDGKFQIFNSCKTF

SEQ ID NO: 13543 - protein, 195 aa, Homo Sapiens
MAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLLKGDLAYNYRGPRTKDDIIEFAHRVSGALIRPLPSQQMFEHMQKRHRVFFVYVGGESPLKEKYIDAASELIVYTYFFSASEEVVPEVIFKI

SEQ ID NO: 13544 - protein, 454 aa, Homo Sapiens
MAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLLKGDLAYNYRGPRTKDDIIEFAHRVSGALIRPLPSQQMFEHMQKRHRVFFVYVGGESPLKEKYIDAASELIVYTYFFSASEEVVPEYVTLKEMPAVLVFKDETYFVYDEYEDGDLSSWINRERFQNYLAMDGFLLYELGDTGKLVALAVIDEKNTSVEHTRLKSIIQEVARDYRDLFHRDFQFGHMDGNDYINTLLMDELTVPTVVVLNTSNQQYFLLDRQIKNVEDMVQFINNILDGTVEAQGGDSILQRLKRIVFDAKSTIVSIFKSSPLMGCFLFGLPLGVISIMCYGIYTADTDGGYIEERYEVSKSENENQEQIEESKEQQEPSSGGSVVPTVQEPKDVLEKKKD

SEQ ID NO: 13545 - protein, 128 aa, Homo Sapiens
MAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLRFPGGLKIGVWPFFIGEIKRGLGI

SEQ ID NO: 13546 - protein, 69 aa, Homo Sapiens
MVVCKGFVEDLDESFKENRNDDIWLVDFYAPWCGHCKKLEPIWNEVGLEMKSIGSPVKVGKMDATSYSN

SEQ ID NO: 13547 - protein, 23 aa, Homo Sapiens
ASTEAEPEVDNLLVSDATPDGFR

SEQ ID NO: 13548 - protein, 92 aa, Homo Sapiens
MGAMTQLLAGVFLAFLALATEGGVLKKVIRHKRQSGVNATLPEENQPVVFNHVYNIKLPVGSQCSVDLESASGEKDLAPPSEPSESFQEHTV

SEQ ID NO: 13549 - protein, 2019 aa, Homo Sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 13550 - protein, 2201 aa, Homo Sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 13551 - protein, 1928 aa, Homo Sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 13552 - protein, 1564 aa, Homo Sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 13553 - protein, 1838 aa, Homo Sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTAKEPEIGNLNVSDITPESFNLSWMATDGIFETFTIEIIDSNRLLETVEYNISGAERTAHISGLPPSTDFIVYLSGLAPSIRTKTISATATTEPKPQLGTLIFSNITPKSFNMSWTTQAGLFAKIVINVSDAHSLHESQQFTVSGDAKQAHITGLVENTGYDVSVAGTTLAGDPTRPLTAFVITEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 13554 - protein, 1838 aa, Homo Sapiens; identical to SEQ ID NO: 13553

SEQ ID NO: 13555 - protein, 615 aa, Homo Sapiens
  misc_feature (1)..(1): Xaa can be any naturally occurring amino acid
XPELENLTVTEVGWDGLRLNWTAADQAYEHFIIQVQEANKVEAARNLTVPGSLRAVDIPGLKAATPYTVSIYGVIQGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRRE

SEQ ID NO: 13556 - protein, 277 aa, Homo Sapiens
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 13557 - protein, 616 aa, Homo Sapiens
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKESSGDSCVSTHTANFGQQGACEGVLLLTLEEKTFPEDMCYPDQGGVCQGTCVGGGPYAQGEDARMLSLVSKTEIEEDSFRQMPTEDEYMDRPSQPTDQLLFLTEPGSKSTPPFSEPLEVGENDSLSQCFTGTQSTVGSESCNCTEPLCRTDWTPMSSENYLQKEVDSGHCPHWAASPSPNWADVCTGCRNPPGEDCEPLVGSPKRGPLPQCAYGMGLPPEEEASRTEARDQPEDGADGRLPSSARAGAGSGSSPGGQSPASGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 13558 - protein, 263 aa, Homo Sapiens
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKEM

SEQ ID NO: 13559 - protein, 263 aa, Homo Sapiens
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKES

SEQ ID NO: 13560 - protein, 337 aa, Homo Sapiens
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 13561 - protein, 299 aa, Homo Sapiens
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 13562 - protein, 145 aa, Homo Sapiens
MNNLLCCALVFLDISIKWTTQETFPPKYLHYDEETSHQLLCDKCPPGTYLKQHCTAKWKTVCAPCPDHYYTDSWHTSDECLYCSPVCKELQYVKQECNRTHNRVCECKEGRYLEIEFCLKHRSCPPGFGVVQAGCRRRPKPQICI

SEQ ID NO: 13563 - protein, 401 aa, Homo Sapiens
MNNLLCCALVFLDISIKWTTQETFPPKYLHYDEETSHQLLCDKCPPGTYLKQHCTAKWKTVCAPCPDHYYTDSWHTSDECLYCSPVCKELQYVKQECNRTHNRVCECKEGRYLEIEFCLKHRSCPPGFGVVQAGTPERNTVCKRCPDGFFSNETSSKAPCRKHTNCSVFGLLLTQKGNATHDNICSGNSESTQKCGIDVTLCEEAFFRFAVPTKFTPNWLSVLVDNLPGTKVNAESVERIKRQHSSQEQTFQLLKLWKHQNKDQDIVKKIIQDIDLCENSVQRHIGHANLTFEQLRSLMESLPGKKVGAEDIEKTIKACKPSDQILKLLSLWRIKNGDQDTLKGLMHALKHSKTYHFPKTVTQSLKKTIRFLHSFTMYKLYQKLFLEMIGNQVQSVKISCL

SEQ ID NO: 13564 - protein, 94 aa, Homo Sapiens
MARGSLRRLLRLLVLGLWLALLRSVAGEQAPASDPRPPPQAPPPAPAAAPGARTWTSAWTARLAGRDRTATSAWAALQHLLPPSGCFGPSLGAL

SEQ ID NO: 13565 - protein, 47 aa, Homo Sapiens
MARGSLRRLLRLLVLGLWLALLRSVAGEQAPDPRIAESRPQPLTRGP

SEQ ID NO: 13566 - protein, 94 aa, Homo Sapiens
MARGSLRRLLRLLVLGLWLALLRSVAGEQAPGAAAPPAPFRLLWPILGGALSLTFVLGLLSGFLVWRRCRRREKFTTPIEETGGEGCPAVALIQ

SEQ ID NO: 13567 - protein, 129 aa, Homo Sapiens
MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRREKFTTPIEETGGEGCPAVALIQ

SEQ ID NO: 13568 - protein, 226 aa, Homo Sapiens
MARGSLRRLLRLLVLGLWLALLRSVAGEQAPGTRDSGVGEPRAGAREPDWVSGEQRRTGGTGGCGDLGSGGLQTARSRLWEVPSLSKLHSQSGPQFLPPSNWGWGGSSVPQVRSTSNGERKRCSTSCPLPAALAHPWGRSEPDLRAGAAFWLFGLETMPQEREVHHPHRGDRRRGLPSCGADPVTMCPLPAGARPLIIHSSILEPVSASQTRREPSSSNHKGGGGR

SEQ ID NO: 13569 - protein, 80 aa, Homo Sapiens
MDCASCRARPHSDFCLGCAAAPPAPFRLLWPILGGALSLTFVLGLLSGFLVWRRCRRREKFTTPIEETGGEGCPAVALIQ

SEQ ID NO: 13570 - protein, 183 aa, Homo Sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQT

SEQ ID NO: 13571 - protein, 231 aa, Homo Sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPR

SEQ ID NO: 13572 - protein, 231 aa, Homo Sapiens; identical to SEQ ID NO: 13571

SEQ ID NO: 13573 - protein, 231 aa, Homo Sapiens; identical to SEQ ID NO: 13571

SEQ ID NO: 13574 - protein, 283 aa, Homo Sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 13575 - protein, 193 aa, Homo Sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTNRAWKSQTDL

SEQ ID NO: 13576 - protein, 25 aa, Homo Sapiens
  misc_feature (1)..(1): Xaa can be any naturally occurring amino acid
XGTLEECQHQTNWPNHMCEKKKAKG

SEQ ID NO: 13577 - protein, 255 aa, Homo Sapiens
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCCWRCRRRPKTPEAASSPRKSGASDRQRRRGGWETCGCEPGRPPGPPTAASPSPGAPQAAGALRSALGRALLPWQQKWVQEGGSDQRPGPCSSAAAAGPCRRERETQSWPPSSLAGPDGVGS

SEQ ID NO: 13578 - protein, 234 aa, Homo Sapiens
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRKTQLLLEVPPSTEDARSCQFPEEERGERSAEEKGRLGDLWV

SEQ ID NO: 13579 - protein, 241 aa, Homo Sapiens
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 13580 - protein, 169 aa, Homo Sapiens
MCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 13581 - protein, 122 aa, Homo Sapiens
MGLSTVPDLLLPLEPTCTMTVQARGRIRTAGSVRAAPSPLQKTTSDTASAAPNAERKWVRWRSLLAQWTGTPCVAAGRTSTGIIGVKTFSSASIAASASMGPCTSPARRNRTPCAPAMQVSF

SEQ ID NO: 13582 - protein, 412 aa, Homo Sapiens
MGLSTVPDLLLPLVLLELLVGIYPSGVIGLVPHLGDREKRDSVCPQGKYIHPQNNSICCTKCHKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 13583 - protein, 72 aa, Homo Sapiens
MGLSTVPDLLLPLVLLELLVGIYPSGVIGLVPHLGDREKRDSVCPQGKYIHPQNNSICCTKCHKEPVPALLE

SEQ ID NO: 13584 - protein, 118 aa, Homo Sapiens
MGLSTVPDLLLPLVLLELLVGIYPSGVIGLVPHLGDREKRDSVCPQGKYIHPQNNSICCTKCHKGPGQDTDCRECESGSFTASENHLRHCLSCSKCRKEMGQVEISSCTVDRDTVCGC

SEQ ID NO: 13585 - protein, 71 aa, Homo Sapiens
MGLSTVPDLLLPLVLLELLVGIYPSGVIGLVPHLGDREKRDSVCPQGKYIHPQNNSICCTKCHKGTYLYND

SEQ ID NO: 13586 - protein, 254 aa, Homo Sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCERSSPEAKPSPHPRGWPLPHAVALPFLPPPVFCGSDNQLLSGRPHPVPRHFLCPVGWGCRRFSFSCAALLPTGQEKQNTVCTCHAGFFLRENECVS

SEQ ID NO: 13587 - protein, 218 aa, Homo Sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSKVLLCRPGWNAVARSRLTATSASQIQAILLLQPPK

SEQ ID NO: 13588 - protein, 298 aa, Homo Sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIGEWGLWEGEGAGGGEGGHGWVRWTCVEGGEECPLSSYRWGLWAEGGPGWLGR

SEQ ID NO: 13589 - protein, 455 aa, Homo Sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 13590 - protein, 155 aa, Homo Sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPDLS

SEQ ID NO: 13591 - protein, 461 aa, Homo Sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 13592 - protein, 126 aa, Homo Sapiens
MEQRPRGCAAVAAALLLVLLGARAQGGTRSPRCDCAGDFHKKIGLFCCRGCPAASQVALENCSAVADTRCGCKPGWFVECQVSQCVSSSPFYCQPCLDCGALHRHTRLLCHPSVTLGQRPHPSSTS

SEQ ID NO: 13593 - protein, 136 aa, Homo Sapiens
MEQRPRGCAAVAAALLLVLLGARAQGGTRSPRCDCAGDFHKKIGLFCCRGCPAASQVALENCSAVADTRCGCKPGWFVECQVSQCVSSSPFYCQPCLDCGALHRHTRLLCSRRDTDCGTCLPGFYEHGDGCVSCPT

SEQ ID NO: 13594 - protein, 372 aa, Homo Sapiens
MEQRPRGCAAVAAALLLVLLGARAQGGTRSPRCDCAGDFHKKIGLFCCRGCPAASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 13595 - protein, 234 aa, Homo Sapiens
MEQRPRGCAAVAAALLLVLLGARAQGGTRSPRCDCAGDFHKKIGLFCCRGCPADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 13596 - protein, 181 aa, Homo Sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPT

SEQ ID NO: 13597 - protein, 277 aa, Homo Sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTPPPSLAGAPWGAVQSAVPLSVAGGRVGGVLGMRVGELGWTEGRRVRRGATTQHPPAAFSVLGPGAPGWPCGPPPAWGHPDLHIPPLLASQAPGYCR

SEQ ID NO: 13598 - protein, 426 aa, Homo Sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTPPPSLAGAPWGAVQSAVPLSVAGGRVGVFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 13599 - protein, 417 aa, Homo Sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 13600 - protein, 380 aa, Homo Sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQNEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 13601 - protein, 253 aa, Homo Sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQSRWCAGNASGRTGMDRGEAGEEGGNHPTPTSCFQCSGSRCSWLALWSPSCLGPP

SEQ ID NO: 13602 - protein, 218 aa, Homo Sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTVLGPGAPGWPCGPPPAWGHPDLHIPPLLASQAPGYCR

SEQ ID NO: 13603 - protein, 45 aa, Homo Sapiens
MFWVQVLLAGLVVPLLLGATLTYTYRHCWPHKPLVTDEAGMEALT

SEQ ID NO: 13604 - protein, 300 aa, Homo Sapiens
MRALEGPGLSLLCLVLALPALLPVPAVRGVAETPTYPWRDAETGERLVCAQCPPGTFVQRPCRRDSPTTCGPCPPRHYTQFWNYLERCRYCNVLCGEREEEARACHATHNRACRCRTGFFAHAGFCLEHASCPPGAGVIAPGTPSQNTQCQPCPPGTFSASSSSSEQCQPHRNCTALGLALNVPGSSSHDTLCTSCTGFPLSTRVPGAEECERAVIDFVAFQDISIKRLQRLLQALEAPEGWGPTPRAGRAALQLKLRRRLTELLGAQDGALLVRLLQALRVARMPGLERSVRERFLPVH

SEQ ID NO: 13605 - protein, 244 aa, Homo Sapiens
MDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 13606 - protein, 244 aa, Homo Sapiens; identical to SEQ ID NO: 13605

SEQ ID NO: 13607 - protein, 244 aa, Homo Sapiens; identical to SEQ ID NO: 13605

SEQ ID NO: 13608 - protein, 270 aa, Homo Sapiens
MFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 13609 - protein, 317 aa, Homo Sapiens
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 13610 - protein, 134 aa, Homo Sapiens
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQADGGYTTCLRP

SEQ ID NO: 13611 - protein, 249 aa, Homo Sapiens
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 13612 - protein, 330 aa, Homo Sapiens
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 13613 - protein, 251 aa, Homo Sapiens
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 13614 - protein, 174 aa, Homo Sapiens
MRHFLSKVYSFPMRKLILFLVFPVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 13615 - protein, 1299 aa, Homo Sapiens
MSLQEMFRFPMGLLLGSVLLVASAPATLEPPGCSNKEQQVTVSHTYKIDVPKSALVQVDADPQPLSDDGASLLALGEAREEQNIIFRHNIRLQTPQKDCELAGSVQDLLARVKKLEEEMVEMKEQCSAQRCCQGVTDLSRHCSGHGTFSLETCSCHCEEGREGPACERLACPGACSGHGRCVDGRCLCHEPYVGADCGYPACPENCSGHGECVRGVCQCHEDFMSEDCSEKRCPGDCSGHGFCDTGECYCEEGFTGLDCAQVVTPQGLQLLKNTEDSLLVSWEPSSQVDHYLLSYYPLGKELSGKQIQVPKEQHSYEILGLLPGTKYIVTLRNVKNEVSSSPQHLLATTDLAVLGTAWVTDETENSLDVEWENPSTEVDYYKLRYGPMTGQEVAEVTVPKSSDPKSRYDITGLHPGTEYKITVVPMRGELEGKPILLNGRTEIDSPTNVVTDRVTEDTATVSWDPVQAVIDKYVVRYTSADGDTKEMAVHKDESSTVLTGLKPGEAYKVYVWAERGNQGSKKADTNALTEIDSPANLVTDRVTENTATISWDPVQATIDKYVVRYTSADDQETREVLVGKEQSSTVLTGLRPGVEYTVHVWAQKGDRESKKADTNAPTDIDSPKNLVTDRVTENMATVSWDPVQAAIDKYVVRYTSAGGETREVPVGKEQSSTVLTGLRPGMEYMVHVWAQKGDQESKKADTKAQTDIDSPQNLVTDRVTENMATVSWDPVRATIDRYVVRYTSAKDGETREVPVGKEQSSTVLTGLRPGVEYTVHVWAQKGAQESKKADTKAQTDIDSPQNLVTDWVTENTATVSWDPVQATIDRYVVHYTSANGETREVPVGKEQSSTVLTGLRPGMEYTVHVWAQKGNQESKKADTKAQTEIDGPKNLVTDWVTENMATVSWDPVQATIDKYMVRYTSADGETREVPVGKEHSSTVLTGLRPGMEYMVHVWAQKGAQESKKADTKAQTELDPPRNLRPSAVTQSGGILTWTPPSAQIHGYILTYQFPDGTVKEMQLGREDQRFALQGLEQGATYPVSLVAFKGGRRSRNVSTTLSTVGARFPHPSDCSQVQQNSNAASGLYTIYLHGDASRPLQVYCDMETDGGGWIVFQRRNTGQLDFFKRWRSYVEGFGDPMKEFWLGLDKLHNLTTGTPARYEVRVDLQTANESAYAIYDFFQVASSKERYKLTVGKYRGTAGDALTYHNGWKFTTFDRDNDIALSNCALTHHGGWWYKNCHLANPNGRYGETKHSEGVNWEPWKGHEFSIPYVELKIRPHGYSREPVLGRKKRTLRGRLRTF

SEQ ID NO: 13616 - protein, 1122 aa, Homo Sapiens
MSLQEMFRFPMGLLLGSVLLVASAPATLEPPGCSNKEQQVTVSHTYKIDVPKSALVQVDADPQPLSDDGASLLALGEAREEQNIIFRHNIRLQTPQKDCELAGSVQDLLARVKKLEEEMVEMKEQCSAQRCCQGVTDLSRHCSGHGTFSLETCSCHCEEGREGPACERLACPGACSGHGRCVDGRCLCHEPYVGADCGYPACPENCSGHGECVRGVCQCHEDFMSEDCSEKRCPGDCSGHGFCDTGECYCEEGFTGLDCAQVVTPQGLQLLKNTEDSLLVSWEPSSQVDHYLLSYYPLGKELSGKQIQVPKEQHSYEILGLLPGTKYIVTLRNVKNEVSSSPQHLLATTDLAVLGTAWVTDETENSLDVEWENPSTEVDYYKLRYGPMTGQEVAEVTVPKSSDPKSRYDITGLHPGTEYKITVVPMRGELEGKPILLNGRTEIDSPTNVVTDRVTEDTATVSWDPVQAVIDKYVVRYTSADGDTKEMAVHKDESSTVLTGLKPGEAYKVYVWAERGNQGSKKADTNALTDIDSPQNLVTDRVTENMATVSWDPVRATIDRYVVRYTSAKDGETREVPVGKEQSSTVLTGLRPGVEYTVHVWAQKGAQESKKADTKAQTDIDSPQNLVTDWVTENTATVSWDPVQATIDRYVVHYTSANGETREVPVGKEQSSTVLTGLRPGMEYTVHVWAQKGNQESKKADTKAQTEIDGPKNLVTDWVTENMATVSWDPVQATIDKYMVRYTSADGETREVPVGKEHSSTVLTGLRPGMEYMVHVWAQKGAQESKKADTKAQTELDPPRNLRPSAVTQSGGILTWTPPSAQIHGYILTYQFPDGTVKEMQLGREDQRFALQGLEQGATYPVSLVAFKGGRRSRNVSTTLSTVGARFPHPSDCSQVQQNSNAASGLYTIYLHGDASRPLQVYCDMETDGGGWIVFQRRNTGQLDFFKRWRSYVEGFGDPMKEFWLGLDKLHNLTTGTPARYEVRVDLQTANESAYAIYDFFQVASSKERYKLTVGKYRGTAGDALTYHNGWKFTTFDRDNDIALSNCALTHHGGWWYKNCHLANPNGRYGETKHSEGVNWEPWKGHEFSIPYVELKIRPHGYSREPVLGRKKRTLRGRLRTF

SEQ ID NO: 13617 - protein, 1122 aa, Homo Sapiens
MSLQEMFRFPMGLLLGSVLLVASAPATLEPPGCSNKEQQVTVSHTYKIDVPKSALVQVDADPQPLSDDGASLLALGEAREEQNIIFRHNIRLQTPQKDCELAGSVQDLLARVKKLEEEMVEMKEQCSAQRCCQGVTDLSRHCSGHGTFSLETCSCHCEEGREGPACERLACPGACSGHGRCVDGRCLCHEPYVGADCGYPACPENCSGHGECVRGVCQCHEDFMSEDCSEKRCPGDCSGHGFCDTGECYCEEGFTGLDCAQVVTPQGLQLLKNTEDSLLVSWEPSSQVDHYLLSYYPLGKELSGKQIQVPKEQHSYEILGLLPGTKYIVTLRNVKNEVSSSPQHLLATTDLAVLGTAWVTDETENSLDVEWENPSTEVDYYKLRYGPMTGQEVAEVTVPKSSDPKSRYDITGLHPGTEYKITVVPMRGELEGKPILLNGRTEIDSPTNVVTDRVTEDTATVSWDPVQAVIDKYVVRYTSADGDTKEMAVHKDESSTVLTGLKPGEAYKVYVWAERGNQGSKKADTNALTEIDSPANLVTDRVTENTATISWDPVQATIDRYVVRYTSAKDGETREVPVGKEQSSTVLTGLRPGVEYTVHVWAQKGAQESKKADTKAQTDIDSPQNLVTDWVTENTATVSWDPVQATIDRYVVHYTSANGETREVPVGKEQSSTVLTGLRPGMEYTVHVWAQKGNQESKKADTKAQTEIDGPKNLVTDWVTENMATVSWDPVQATIDKYMVRYTSADGETREVPVGKEHSSTVLTGLRPGMEYMVHVWAQKGAQESKKADTKAQTELDPPRNLRPSAVTQSGGILTWTPPSAQIHGYILTYQFPDGTVKEMQLGREDQRFALQGLEQGATYPVSLVAFKGGRRSRNVSTTLSTVGARFPHPSDCSQVQQNSNAASGLYTIYLHGDASRPLQVYCDMETDGGGWIVFQRRNTGQLDFFKRWRSYVEGFGDPMKEFWLGLDKLHNLTTGTPARYEVRVDLQTANESAYAIYDFFQVASSKERYKLTVGKYRGTAGDALTYHNGWKFTTFDRDNDIALSNCALTHHGGWWYKNCHLANPNGRYGETKHSEGVNWEPWKGHEFSIPYVELKIRPHGYSREPVLGRKKRTLRGRLRTF

SEQ ID NO: 13618 - protein, 1358 aa, Homo Sapiens
MGADGETVVLKNMLIGINLILLGSMIKPSECQLEVTTERVQRQSVEEEGGIANYNTSSKEQPVVFNHVYNINVPLDNLCSSGLEASAEQEVSAEDETLAEYMGQTSDHESQVTFTHRINFPKKACPCASSAQVLQELLSRIEMLEREVSVLRDQCNANCCQESAATGQLDYIPHCSGHGNFSFESCGCICNEGWFGKNCSEPYCPLGCSSRGVCVDGQCICDSEYSGDDCSELRCPTDCSSRGLCVDGECVCEEPYTGEDCRELRCPGDCSGKGRCANGTCLCEEGYVGEDCGQRQCLNACSGRGQCEEGLCVCEEGYQGPDCSAVAPPEDLRVAGISDRSIELEWDGPMAVTEYVISYQPTALGGLQLQQRVPGDWSGVTITELEPGLTYNISVYAVISNILSLPITAKVATHLSTPQGLQFKTITETTVEVQWEPFSFSFDGWEISFIPKNNEGGVIAQVPSDVTSFNQTGLKPGEEYIVNVVALKEQARSPPTSASVSTVIDGPTQILVRDVSDTVAFVEWIPPRAKVDFILLKYGLVGGEGGRTTFRLQPPLSQYSVQALRPGSRYEVSVSAVRGTNESDSATTQFTTEIDAPKNLRVGSRTATSLDLEWDNSEAEVQEYKVVYSTLAGEQYHEVLVPRGIGPTTRATLTDLVPGTEYGVGISAVMNSQQSVPATMNARTELDSPRDLMVTASSETSISLIWTKASGPIDHYRITFTPSSGIASEVTVPKDRTSYTLTDLEPGAEYIISVTAERGRQQSLESTVDAFTGFRPISHLHFSHVTSSSVNITWSDPSPPADRLILNYSPRDEEEEMMEVSLDATKRHAVLMGLQPATEYIVNLVAVHGTVTSEPIVGSITTGIDPPKDITISNVTKDSVMVSWSPPVASFDYYRVSYRPTQVGRLDSSVVPNTVTEFTITRLNPATEYEISLNSVRGREESERICTLVHTAMDNPVDLIATNITPTEALLQWKAPVGEVENYVIVLTHFAVAGETILVDGVSEEFRLVDLLPSTHYTATMYATNGPLTSGTISTNFSTLLDPPANLTASEVTRQSALISWQPPRAEIENYVLTYKSTDGSRKELIVDAEDTWIRLEGLLENTDYTVLLQAAQDTTWSSITSTAFTTGGRVFPHPQDCAQHLMNGDTLSGVYPIFLNGELSQKLQVYCDMTTDGGGWIVFQRRQNGQTDFFRKWADYRVGFGNVEDEFWLGLDNIHRITSQGRYELRVDMRDGQEAAFASYDRFSVEDSRNLYKLRIGSYNGTAGDSLSYHQGRPFSTEDRDNDVAVTNCAMSYKGAWWYKNCHRTNLNGKYGESRHSQGINWYHWKGHEFSIPFVEMKMRPYNHRLMAGRKRQSLQF

SEQ ID NO: 13619 - protein, 1358 aa, Homo Sapiens; identical to SEQ ID NO: 13618

SEQ ID NO: 13620 - protein, 181 aa, Homo Sapiens
  misc_feature (1)..(1): Xaa can be any naturally occurring amino acid
XINFPKKACPCASSAQVLQELLSRIEMLEREVSVLRDQCNANCCQESAATVAPPEDLRVAGISDRSIELEWDGPMAVTEYVISYQPTALGGLQLQQRVPGDWSGVTITELEPGLTYNISVYAVISNILSLPITAKVATHLSTPQGLQFKTITETTVEVQWEPFSFSFDGWEISFIPKNNEG

SEQ ID NO: 13621 - protein, 1962 aa, Homo Sapiens
APGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPGPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTEDEAETTQAVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 13622 - protein, 8 aa, Homo Sapiens
MMPAQYAL

SEQ ID NO: 13623 - protein, 4244 aa, Homo Sapiens
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPGPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTAPEDEAETTQAVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 13624 - protein, 842 aa, Homo Sapiens
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTASPLLCSASPHSPAKAEAEISTSWRNQDSLNFFFCLNIFFCCCYKNTLITRQEFGN

SEQ ID NO: 13625 - protein, 4244 aa, Homo Sapiens; identical to SEQ ID NO: 13623

SEQ ID NO: 13626 - protein, 1545 aa, Homo Sapiens
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTEEREEESPPRPSLSQPPRRPWGNLTAELSRFRGTVQDLERHLRAHGYPLRANQTYTSVARHIHEYLQRQVLGSSADGALLVSLDGLRGQFERVVLRWRPQPPAEGPGGELTVPGTTRTVSLPDLRPGTTYHVEVHGVRAGQTSKSYAFITTTGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVT

SEQ ID NO: 13627 - protein, 673 aa, Homo Sapiens
MRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 13628 - protein, 1720 aa, Homo Sapiens
MAAAPSALLLLPPFPVLSTYRLQSRSRPSAPETDDSRVGGIMRGEKNYYFRGAAGDHGSCPTTTSPLASALLMPSEAVSSSWSESGGGLSGGDEEDTRLLQLLRTARDPSEAFQALQAALPRRGGRLGFPRRKEALYRALGRVLVEGGSDEKRLCLQLLSDVLRGQGEAGQLEEAFSLALLPQLVVSLREENPALRKDALQILHICLKRSPGEVLRTLIQQGLESTDARLRASTALLLPILLTTEDLLLGLDLTEVIISLARKLGDQETEEESETAFSALQQIGERLGQDRFQSYISRLPSALRRHYNRRLESQFGSQVPYYLELEASGFPEDPLPCAVTLSNSNLKFGIIPQELHSRLLDQEDYKNRTQAVEELKQVLGKFNPSSTPHSSLVGFISLLYNLLDDSNFKVVHGTLEVLHLLVIRLGEQVQQFLGPVIAASVKVLADNKLVIKQEYMKIFLKLMKEVGPQQVLCLLLEHLKHKHSRVREEVVNICICSLLTYPSEDFDLPKLSFDLAPALVDSKRRVRQAALEAFAVLASSMGSGKTSILFKAVDTVELQDNGDGVMNAVQARLARKTLPRLTEQGFVEYAVLMPSSAGGRSNHLAHGADTDWLLAGNRTQSAHCHCGDHVRDSMHIYGSYSPTICTRRVLSAGKGKNKLPWENEQPGIMGENQTSTSKDIEQFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEMHSSLRSLRNSAAKKRAKLSGSTSDLESPDSAMKLDLTMDSPSLSSSPNINSYSESGVYSQESLTSSLSTTPQGKRIMSDIFPTFGSKPCPTRLSSAKKKISHIAEQSPSAGSSSNPQQISSFDFTTTKALSEDSVVVVGKGVFGSLSSAPATCSQSVISSVENGDTFSIKQSIEPPSGIYGRSVQQNISSYLDVENEKDAKVSISKSTYNKMRQKRKEEKELFHNKDCEKKEKNSWERMRHTGTEKMASESETPTGAISQYKERMPSVTHSPEIMDLSELRPFSKPEIALTEALRLLADEDWEKKIEGLNFIRCLAAFHSEILNTKLHETNFAVVQEVKNLRSGVSRAAVVCLSDLFTYLKKSMDQELDTTVKVLLHKAGESNTFIREDVDKALRAMVNNVTPARAVVSLINGGQRYYGRKMLFFMMCHPNFEKMLEKYVPSKDLPYIKDSVRNLQQKGLGEIPLDTPSAKGRRSHTGSVGNTRSSSVSRDAFNSAERAVTEVREVTRKSVPRNSLESAEYLKLITGLLNAKDFRDRINGIKQLLSDTENNQDLVVGNIVKIFDAFKSRLHDSNSKVNLVALETMHKMIPLLRDHLSPIINMLIPAIVDNNLNSKNPGIYAAATNVVQALSQHVDNYLLLQPFCTKAQFLNGKAKQDMTEKLADIVTELYQRKPHATEQKVLVVLWHLLGNMTNSGSLPGAGGNIRTATAKLSKALFAQMGQNLLNQAASQPPHIKKSLEELLDMTILNEL

SEQ ID NO: 13629 - protein, 1773 aa, Homo Sapiens
MAAAPSALLLLPPFPVLSTYRLQSRSRPSAPETDDSRVGGIMRGEKNYYFRGAAGDHGSCPTTTSPLASALLMPSEAVSSSWSESGGGLSGGDEEDTRLLQLLRTARDPSEAFQALQAALPRRGGRLGFPRRKEALYRALGRVLVEGGSDEKRLCLQLLSDVLRGQGEAGQLEEAFSLALLPQLVVSLREENPALRKDALQILHICLKRSPGEVLRTLIQQGLESTDARLRASTALLLPILLTTEDLLLGLDLTEVIISLARKLGDQETEEESETAFSALQQIGERLGQDRFQSYISRLPSALRRHYNRRLESQFGSQVPYYLELEASGFPEDPLPCAVTLSNSNLKFGIIPQELHSRLLDQEDYKNRTQAVEELKQVLGKFNPSSTPHSSLVGFISLLYNLLDDSNFKVVHGTLEVLHLLVIRLGEQVQQFLGPVIAASVKVLADNKLVIKQEYMKIFLKLMKEVGPQQVLCLLLEHLKHKHSRVREEVVNICICSLLTYPSEDFDLPKLSFDLAPALVDSKRRVRQAALEAFAVLASSMGSGKTSILFKAVDTVELQDNGDGVMNAVQARLARKTLPRLTEQGFVEYAVLMPSSAGGRSNHLAHGADTDWLLAGNRTQSAHCHCGDHVRDSMHIYGSYSPTICTRRVLSAGKGKNKLPWENEQPGIMGENQTSTSKDIEQFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEMHSSLRSLRNSAAKKRAKLSGSTSDLESPDSAMKLDLTMDSPSLSSSPNINSYSESGVYSQESLTSSLSTTPQGKRIMSDIFPTFGSKPCPTRLSSAKKKISHIAEQSPSAGSSSNPQQISSFDFTTTKALSEDSVVVVGKGVFGSLSSAPATCSQSVISSVENGDTFSIKQSIEPPSGIYGRSVQQNISSYLDVENEKDAKVSISKSTYNKMRQKRKEEKELFHNKDCEKKEKNSWERMRHTGTEKMASESETPTGAISQYKERMPSVTHSPEIMDLSELRPFSKPEIALTEALRLLADEDWEKKIEGLNFIRCLAAFHSEILNTKLHETNFAVVQEVKNLRSGVSRAAVVCLSDLFTYLKKSMDQELDTTVKVLLHKAGESNTFIREDVDKALRAMVNNVTPARAVVSLINGGQSHLHIAVRRCTAQHLSDVLEFMEPERILSAAKDMAERILPAAAKFAQDSSQETRYYGRKMLFFMMCHPNFEKMLEKYVPSKDLPYIKDSVRNLQQKGLGEIPLDTPSAKGRRSHTGSVGNTRSSSVSRDAFNSAERAVTEVREVTRKSVPRNSLESAEYLKLITGLLNAKDFRDRINGIKQLLSDTENNQDLVVGNIVKIFDAFKSRLHDSNSKVNLVALETMHKMIPLLRDHLSPIINMLIPAIVDNNLNSKNPGIYAAATNVVQALSQHVDNYLLLQPFCTKAQFLNGKAKQDMTEKLADIVTELYQRKPHATEQKVLVVLWHLLGNMTNSGSLPGAGGNIRTATAKLSKALFAQMGQNLLNQAASQPPHIKKSLEELLDMTILNEL

SEQ ID NO: 13630 - protein, 995 aa, Homo Sapiens
MAAAPSALLLLPPFPVLSTYRLQSRSRPSAPETDDSRVGGIMRGEKNYYFRGAAGDHGSCPTTTSPLASALLMPSEAVSSSWSESGGGLSGGDEEDTRLLQLLRTARDPSEAFQALQAALPRRGGRLGFPRRKEALYRALGRVLVEGGSDEKRLCLQLLSDVLRGQGEAGQLEEAFSLALLPQLVVSLREENPALRKDALQILHICLKRSPGEVLRTLIQQGLESTDARLRASTALLLPILLTTEDLLLGLDLTEVIISLARKLGDQETEEESETAFSALQQIGERLGQDRFQSYISRLPSALRRHYNRRLESQFGSQVPYYLELEASGFPEDPLPCAVTLSNSNLKFGIIPQELHSRLLDQEDYKNRTQAVEELKQVLGKFNPSSTPHSSLVGFISLLYNLLDDSNFKVVHGTLEVLHLLVIRLGEQVQQFLGPVIAASVKVLADNKLVIKQEYMKIFLKLMKEVGPQQVLCLLLEHLKHKHSRVREEVVNICICSLLTYPSEDFDLPKLSFDLAPALVDSKRRVRQAALEAFAVLASSMGSGKTSILFKAVDTVELQDNGDGVMNAVQARLARKTLPRLTEQGFVEYAVLMPSSAGGRSNHLAHGADTDWLLAGNRTQSAHCHCGDHVRDSMHIYGSYSPTICTRRVLSAGKGKNKLPWENEQPGIMGENQTSTSKDIEQFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEVRHISNIWVKTLSNKTFFCKEKNFSYC

SEQ ID NO: 13631 - protein, 174 aa, Homo Sapiens
MFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKS

SEQ ID NO: 13632 - protein, 155 aa, Homo Sapiens
SRLHDSNSKVNLVALETMHKMIPLLRDHLSPIINMLIPAIVDNNLNSKNPGIYAAATNVVQALSQHVDIVTELYQRKPHATEQKVLVVLWHLLGNMTNSGSLPGAGGNIRTATAKLSKALFAQMGQNLLNQAASQPPHIKKSLEELLDMTILNEL

SEQ ID NO: 13633 - protein, 160 aa, Homo Sapiens
  misc_feature (1)..(1): Xaa can be any naturally occurring amino acid
XFSRKRVSRNLFQNSRDFNPDCLPLCAAGTTGTHQTNLSGKCAQLGFSQICGKTGSVGSDLQFLGTTSSHQEKGENSQEKPPVQLTPALVRSPSSRRGLNGTKPVPPIPRGISLLPDKADLSTVGHKKKEPDDIWKCEKDSLPIDLSELNFKDKDLDQEE

SEQ ID NO: 13634 - protein, 51 aa, Homo Sapiens
MIIIIVVGCLCFLTCTMKGLDDFYYCPHFTGFKRGADPGMPEPTVLSLLWG

SEQ ID NO: 13635 - protein, 55 aa, Homo Sapiens [sequence omitted]

SEQ ID NO: 13636 - protein, 125 aa, Homo Sapiens
MVKLSKEAKQRLQQLFKGSQFAIRWGFIPLVIYLGFKRGADPGMPEPTVLRVWWLTPVISALWKAKVGRSWEDCLKLGVQDQPGQRSETHLYQKKKTYFGDKGLFGLLDLEAISGQHGRCVLWLG

SEQ ID NO: 13637 - protein, 55 aa, Homo Sapiens
MVKLSKEAKQRLQQLFKGSQFAIRWGFIPLVIYLGFKRGADPGMPEPTVLSLLWG

SEQ ID NO: 13638 - protein, 49 aa, Homo Sapiens
ATFYGRMLDHEYTTKEVFRKNFFNDWRKAPLLDPLLWPDATPLPFTTAL

SEQ ID NO: 13639 - protein, 164 aa, Homo Sapiens
MKSHPRKKAKNSQKGPFRNVCCTCFPLSDPSETSCCSEDTHPSRPGPPGPQQHYLAGVTCRSPGSGRWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDF

SEQ ID NO: 13640 - protein, 134 aa, Homo Sapiens
MKSHPRKKAKWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDFTEIHRYFVDKAAARKVLSREEKQKLKE

SEQ ID NO: 13641 - protein, 33 aa, Homo Sapiens
MLDHEYTTKEVFRKNFFNDWRKEMAVEEREVIK

SEQ ID NO: 13642 - protein, 201 aa, Homo Sapiens
MLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRA

SEQ ID NO: 13643 - protein, 221 aa, Homo Sapiens
MLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFID

SEQ ID NO: 13644 - protein, 376 aa, Homo Sapiens
MLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTVSWDGPAKPRNYRDHFPPQTTSLNKHLQELMDGLTAKVFRTYNASITLQEQLRALTRAEDSIAAKILSY

SEQ ID NO: 13645 - protein, 503 aa, Homo Sapiens
MLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTTTSLNKHLQELMDGLTAKVFRTYNASITLQEQLRALTRAEDSIAAKILSYNRANRVVAILCNHQRATPSTFEKSMQNLQTKIQAKKEQVAEARAELRRARAEHKAQGDGKSRSVLEKKRRLLEKLQEQLAQLSVQATDKEENKQVALGTSKLNYLDPRISIAWCKRFRVPVEKIYSKTQRERFAWALAMAGEDFEF

SEQ ID NO: 13646 - protein, 503 aa, Homo Sapiens; identical to SEQ ID NO: 13645

SEQ ID NO: 13647 - protein, 503 aa, Homo Sapiens; identical to SEQ ID NO: 13645

SEQ ID NO: 13648 - protein, 164 aa, Homo Sapiens
MRVVRLLRLRAALTLLGEVPRRPASRGVPGSRRTQKGSGARNSQKGPFRNVCCTCFPLSDPSETSCCSEDTHPSRPGPPGPQQHYLAGVTCRSPGSGRWEKEKHEDGVKWRQLEHKGPYFAPPYEPLPDGVRFFYEGRPVRLSVAAEEVATFYGRMLDHEYTTK

SEQ ID NO: 13649 - protein, 601 aa, Homo Sapiens
MRVVRLLRLRAALTLLGEVPRRPASRGVPGSRRTQKGSGARWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTTTSLNKHLQELMDGLTAKVFRTYNASITLQEQLRALTRAEDSIAAKILSYNRANRVVAILCNHQRATPSTFEKSMQNLQTKIQAKKEQVAEARAELRRARAEHKAQGDGKSRSVLEKKRRLLEKLQEQLAQLSVQATDKEENKQVALGTSKLNYLDPRISIAWCKRFRVPVEKIYSKTQRERFAWALAMAGEDFEF

SEQ ID NO: 13650 - protein, 167 aa, Homo Sapiens
MRVVRLLRLRAALTLLGEVPRRPASRGVPGSRRTQKGSGARWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDFTEIHRYFVDKAAARKVLSREEKQMVTKKK

SEQ ID NO: 13651 - protein, 111 aa, Homo Sapiens
  misc_feature (1)..(1): Xaa can be any naturally occurring amino acid
XEQVAEARAELRRARAEHKAQGDGKSRSVLEKKRRLLEKLQEQLAQLSVQATDKEENKQVALGTSKLNYLDPRISIAWCKRFRVPVEKIYSKTQRERFAWALAMAGEDFEF

SEQ ID NO: 13652 - protein, 123 aa, Homo Sapiens
  misc_feature (1)..(1): Xaa can be any naturally occurring amino acid
XLRLRAALTLLGEVPRRPASRGVPGSRRTQKGSGARWEKEKHEDGVKWRQLEHKGPYFAPPYEPLPDGVRFFYEGRPVRLSVAAEEVATFYGRMLDHEYTTKEVFRKNFFNDWRKVLCQTHML

SEQ ID NO: 13653 - protein, 332 aa, Homo Sapiens
MKLGRAVLGLLLLAPSVVQAVEPISLGLALAGVLTGYIYPRLYCLFAECCGQKRSLSREALQKDLDDNLFGQHLAKKIILNAVFGFINNPKPKKPLTLSLHGWTGTGKNFVSKIIAENIYEGGLNSDYVHLFVATLHFPHASNITLYKDQLQLWIRGNVSACARSIFIFDEMDKMHAGLIDAIKPFLDYYDLVDGVSYQKAMFIFLSNAGAERITDVALDFWRSGKQREDIKLKDIEHALSVSVFNNKNSGFWHSSLIDRNLIDYFVPFLPLEYKHLKMCIRVEMQSRGYEIDEDIVSRVAEEMTFFPKEERVFSDKGCKTVFTKLDYYYDD

SEQ ID NO: 13654 - protein, 336 aa, Homo Sapiens
MLRAGWLRGAAALALLLAARVVAAFEPITVGLAIGAASAITGYLSYNDIYCRFAECCREERPLNASALKLDLEEKLFGQHLATEVIFKALTGFRNNKNPKKPLTLSLHGWAGTGKNFVSQIVAENLHPKGLKSNFVHLFVSTLHFPHEQKIKLYQDQLQKWIRGNVSACANSVFIFDEMDKLHPGIIDAIKPFLDYYEQVDGVSYRKAIFIFLSNAGGDLITKTALDFWRAGRKREDIQLKDLEPVLSVGVFNNKHSGLWHSGLIDKNLIDYFIPFLPLEYRHVKMCVRAEMRARGSAIDEDIVTRVAEEMTFFPRDEKIYSDKGCKTVQSRLDFH

SEQ ID NO: 13655 - protein, 141 aa, Homo Sapiens
  misc_feature (1)..(1): Xaa can be any naturally occurring amino acid
XRVVAAFEPITVGLAIGAASAITGYLSYNDIYCRFAECCREERPLNASALKLDLEEKLFGQHLATEVIFKALTGFRNNKNPKKPLTLSLHGWAGTGKNFVSQIVAENLHPKGLKSNFVHLFVSTLHFPHEQKIKLYQSSLT

SEQ ID NO: 13656 - protein, 72 aa, Homo Sapiens
MAAATRGCRPWGSLLGLLGLVSAAAAAWDLASLRCTLGAFCECDFRPDLPEGSEELGPREPHCLWPLPLPLR

SEQ ID NO: 13657 - protein, 72 aa, Homo Sapiens; identical to SEQ ID NO: 13656

SEQ ID NO: 13658 - protein, 72 aa, Homo Sapiens; identical to SEQ ID NO: 13656

SEQ ID NO: 13659 - protein, 72 aa, Homo Sapiens; identical to SEQ ID NO: 13656

SEQ ID NO: 13660 - protein, 253 aa, Homo Sapiens
MAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFIRWGPALQWAQWGGHFSEVQLYSLSLCSQQNPVPHGLSWAFPVPSATLRDDIVIPPG

SEQ ID NO: 13661 - protein, 242 aa, Homo Sapiens
MAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFIRWLLKLGHHGRAPPRRSGALPPAPAAPRPALRAQRAGPAGPGAKG

SEQ ID NO: 13662 - protein, 321 aa, Homo Sapiens
MAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFISNTGGKQINQVALEAWRSRRDREEILLQELEPVISRAVLDNPHHGFSNSGIMEERLLDAVVPFLPLQRHHVRHCVLNELAQLGLEPRDEVVQAVLDSTTFFPEDEQLFSSNGCKTVASRIAFFL

SEQ ID NO: 13663 - protein, 174 aa, Homo Sapiens
MGLCVPFAVTTSFLSLGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPEGHRAESPWTIFLFLSNLRGDIINE

SEQ ID NO: 13664 - protein, 97 aa, Homo Sapiens
MLRGPWRQLWLFFLLLLPGAPEPRGASRPWEGTDEPGSAWAWPGFQRLQEQLRAAGALSKRYWTLFSCQVWPDDCDEDEEAATGPLALGNVRCGHAW

SEQ ID NO: 13665 - protein, 153 aa, Homo Sapiens
MLRGPWRQLWLFFLLLLPGAPEPRGASRPWEGTDEPGSAWAWPGFQRLQEQLRAAGALSKRYWTLFSCQVWPDDCDEDEEAATGPLGWRLPLLGQRYLDLLTTWYCSFKDCCPRGDCRISNNFTGKNFVARMLVENLYRDGLMSDCVRMFIAT

SEQ ID NO: 13666 - protein, 397 aa, Homo Sapiens
MLRGPWRQLWLFFLLLLPGAPEPRGASRPWEGTDEPGSAWAWPGFQRLQEQLRAAGALSKRYWTLFSCQVWPDDCDEDEEAATGPLGWRLPLLGQRYLDLLTTWYCSFKDCCPRGDCRISNNFTGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPEGHRAESPWTIFLFLSNLRGDIINEVVLKLLKAGWSREEITMEHLEPHLQAEIVETIDNGFGHSRLVKENLIDYFIPFLPLEYRHVRLCARDAFLSQELLYKEETLDEIAQMMVYVPKEEQLFSSQGCKSISQRINYFLS

SEQ ID NO: 13667 - protein, 336 aa, Homo Sapiens
MLRGPWRQLWLFFLLLLPGAPEPRGASRPWEGTDEPGSAWAWPGFQRLQEQLRAAGALSKRYWTLFSCQVWPDDCDEDEEAATGPLGWRLPLLGQRYLDLLTTWYCSFKDCCPRGDCRISNNFTGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPEGHRAESPWTIFLFLSNLRGDIINEVVLKLLKAGWSREEITMEHLEPHLQAEIVETIGFSFLTTRWPHLDLPTSSVAPT

SEQ ID NO: 13668 - protein, 151 aa, Homo Sapiens
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSARSKLLAAETELLCLLY

SEQ ID NO: 13669 - protein, 233 aa, Homo Sapiens
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKLQAFSHSFRNSPTFKSFEEKVENLKSKVGGTKPAGGDFGEVLNSAANASATTTEPLPEKTQESL

SEQ ID NO: 13670 - protein, 247 aa, Homo Sapiens
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKLQAFSHSFSIRSIQHSISMPAMRNSPTFKSFEEKVENLKSKVGGTKPAGGDFGEVLNSAANASATTTEPLPEKTQESL

SEQ ID NO: 13671 - protein, 224 aa, Homo Sapiens
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKNSPTFKSFEEKVENLKSKVGGTKPAGGDFGEVLNSAANASATTTEPLPEKTQESL

SEQ ID NO: 13672 - protein, 238 aa, Homo Sapiens
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVNIRSIQHSISMPAMRNSPTFKSFEEKVENLKSKVGGTKPAGGDFGEVLNSAANASATTTEPLPEKTQESL

SEQ ID NO: 13673 - protein, 38 aa, Homo Sapiens
MDRGEQAFYFIWNFWLELGKDLSFLHSYKMSAENRPSP

SEQ ID NO: 13674 - protein, 38 aa, Homo Sapiens; identical to SEQ ID NO: 13673

SEQ ID NO: 13675 - protein, 111 aa, Homo Sapiens
MDRGEQGLLRTDPVPEEGEDVAATISATETLSEEEQEELRRELAKVEEEIQTLSQVLAAKEKHLAEIKRKLGINSLQELKQNIAKGWQDVTATSARSKLLAAETELLCLLY

SEQ ID NO: 13676 - protein, 207 aa, Homo Sapiens
MDRGEQGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKLQAFSHSFSIRSIQHSISMPAMRNSPTFKSFEEKVENLKSKVGGTKPAGGDFGEVLNSAANASATTTEPLPEKTQESL

SEQ ID NO: 13677 - protein, 184 aa, Homo Sapiens
MDRGEQGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKNSPTFKSFEEKVENLKSKVGGTKPAGGDFGEVLNSAANASATTTEPLPEKTQESL

SEQ ID NO: 13678 - protein, 61 aa, Homo Sapiens
MDRGEQGRRRNPDSVSSVSSKREASSRDQAETWNQFSTGTKTEHCQRVARRDSNICLQEDI

SEQ ID NO: 13679 - protein, 60 aa, Homo Sapiens
MPAMRNSPTFKSFEEKVENLKSKVGGTKPAGGDFGEVLNSAANASATTTEPLPEKTQESL

SEQ ID NO: 13680 - protein, 148 aa, Homo Sapiens
  misc_feature (1)..(1): Xaa can be any naturally occurring amino acid
XGLGLGLWLGAGLSAARRLEQVPSLLGRRRKLHLPDPDLASWGPGRSGSGGGRWDCMCECLLRTDPVPEEGEDVAATISATETLSEEEQEELRRELAKVEEEIQTLSQVLAAKEKHLAEIKRKLGINSLQELKQNIAKGWQDVTATSA

SEQ ID NO: 13681 - protein, 172 aa, Homo Sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTA

SEQ ID NO: 13682 - protein, 933 aa, Homo Sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 13683 - protein, 933 aa, Homo Sapiens; identical to SEQ ID NO: 13682

SEQ ID NO: 13684 - protein, 889 aa, Homo Sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 13685 - protein, 876 aa, Homo Sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 13686 - protein, 760 aa, Homo Sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 13687 - protein, 174 aa, Homo Sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRKMKYKPDHSETAN

SEQ ID NO: 13688 - protein, 174 aa, Homo Sapiens; identical to SEQ ID NO: 13687

SEQ ID NO: 13689 - protein, 864 aa, Homo Sapiens
QLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDSGRLPRVTWISMSLAALLIGGFAGLTSTVICRWTRTGTKSTLPISETGGGTPELRCGKHQAVGTSPQRAAAQDSEQVGHTMPHVSSCHRSGWTGSGCRSSSAGAPCIFLFTPCFLVRSAPSSGRFYLQANDSEPECEPA

SEQ ID NO: 13690 - protein, 404 aa, Homo Sapiens
  misc_feature (1)..(1): Xaa can be any naturally occurring amino acid
XYEGYDSTANPTVSNVFSTAAFRFGHATIHPLVRRLDASFQEHPDLPGLWLHQAFFSPWTLLRGGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWRVLGWKAGILTGCREPSEGKVAGHCRTASCSQNHRTTLFQTQANPKSAGRLFSQHG

SEQ ID NO: 13691 - protein, 363 aa, Homo Sapiens
YEGYDSTANPTVSNVFSTAAFRFGHATIHPLVRRLDASFQEHPDLPGLWLHQAFFSPWTLLRGGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 13692 - protein, 30 aa, Homo Sapiens
MGLQACLLGLFALILSGKCSYSPEPDQRRT

SEQ ID NO: 13693 - protein, 39 aa, Homo Sapiens
MGLQACLLGLFALILSGKCSYSPEPDQRRTKIPDPRECG

SEQ ID NO: 13694 - protein, 39 aa, Homo Sapiens; identical to SEQ ID NO: 13693

SEQ ID NO: 13695 - protein, 81 aa, Homo Sapiens
MGLQACLLGLFALILSGKCSYSPEPDQRRTLPPGWVSLGRADPEEELSLTFALRQQNVERLSELVQAVSDPSSPQYGAFWD

SEQ ID NO: 13696 - protein, 563 aa, Homo Sapiens
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHRFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 13697 - protein, 500 aa, Homo Sapiens
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHRFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 13698 - protein, 162 aa, Homo Sapiens
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVWGDCTVFPQHHP

SEQ ID NO: 13699 - protein, 470 aa, Homo Sapiens
MGLQACLLGLFALILSGKCSYSPEPDQRRTLPPGWVSLGRADPEEELSLTFALRQQNVERLSELVQAVSDPSSPQYVGGLHRFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 13700 - protein, 40 aa, Homo Sapiens
MGLQAWALCPHPLWQMQLQPGARPAEDAAPRLGVPGPCGP

SEQ ID NO: 13701 - protein, 99 aa, Homo Sapiens
MRLFGGNFAHQASVARVVGQQGRGRAGIEASLDVQYLMSAGANISTWVYSSPGDSGAGCWSVSGRHQFRPTFPASRSQAPNLLCGIQLPLFLFVSSQAF

SEQ ID NO: 13702 - protein, 162 aa, Homo Sapiens
MRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASRSQAPNLLCGIQLPLFLFVSSQAF

SEQ ID NO: 13703 - protein, 320 aa, Homo Sapiens
MRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 13704 - protein, 320 aa, Homo Sapiens; identical to SEQ ID NO: 13703

SEQ ID NO: 13705 - protein, 320 aa, Homo Sapiens; identical to SEQ ID NO: 13703

SEQ ID NO: 13706 - protein, 320 aa, Homo Sapiens; identical to SEQ ID NO: 13703

SEQ ID NO: 13707 - protein, 171 aa, Homo Sapiens
  misc_feature (1)..(1): Xaa can be any naturally occurring amino acid
XAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFGDSGAGCWSVSGRHQFRPTFPASSPYVTTVGGTSFQEPFLITNEIVDYISGGGFSNVFPRPSYQEEA

SEQ ID NO: 13708 - protein, 400 aa, Homo Sapiens
  misc_feature (1)..(1): Xaa can be any naturally occurring amino acid
XGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 13709 - protein, 92 aa, Homo Sapiens
  misc_feature (1)..(1): Xaa can be any naturally occurring amino acid
XLQWLMLLSNESALPHVHTVSYGDDEDSLSSAYIQRVNTELMKAAARGLTLLFASGDSGAGCWSVSGRHQFRPTFPASSGRHILPGTFPHHK

SEQ ID NO: 13710 - protein, 282 aa, Homo Sapiens
MLLLAPQMLNLLLLALPVLASRAYAAPAPGQALQRVGIVGGQEAPRSKWPWQVSLRVHGPYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 13711 - protein, 275 aa, Homo Sapiens
MLNLLLLALPVLASRAYAAPAPGQALQRVGIVGGQEAPRSKWPWQVSLRVHGPYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 13712 - protein, 213 aa, Homo Sapiens
YWMHFCGGSLIHPQWVLTAAHCVGPVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 13713 - protein, 282 aa, Homo Sapiens
MLLLAPQMLNLLLLALPVLASRAYAAPAPGQALQRVGIVGGQEAPRSKWPWQVSLRVRDRYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 13714 - protein, 275 aa, Homo Sapiens
MLNLLLLALPVLASRAYAAPAPGQALQRVGIVGGQEAPRSKWPWQVSLRVRDRYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 13715 - protein, 292 aa, Homo Sapiens
MLNLLLLALPVLASRAYAAPAPGQALQRVGIVGGQEAPRSKWPWQVSLRVRDRYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKPDGVSPCWPVWSRTPDLK

SEQ ID NO: 13716 - protein, 242 aa, Homo Sapiens
MLLLAPQMLSLLLLALPVLASPAYVAPAPGQALQQTGIVGGQEAPRSKWPWQVSLRVRGPYWMHFCGGSLIHPQWVLTAAHCVEPDIKDLAALRVQLREQHLYYQDQLLPVSRIIVHPQFYIIQTGADIALLELEEPVNISSHIHTVTLPPASETFPPGMPCWVTGWGDVDNNVHLPPPYPLKEVEVPVVENHLCNAEYHTGLHTGHSFQIVRDDMLCAGSENHDSCQGDSGGPLVCKVNGT

SEQ ID NO: 13717 - protein, 235 aa, Homo Sapiens
MLSLLLLALPVLASPAYVAPAPGQALQQTGIVGGQEAPRSKWPWQVSLRVRGPYWMHFCGGSLIHPQWVLTAAHCVEPDIKDLAALRVQLREQHLYYQDQLLPVSRIIVHPQFYIIQTGADIALLELEEPVNISSHIHTVTLPPASETFPPGMPCWVTGWGDVDNNVHLPPPYPLKEVEVPVVENHLCNAEYHTGLHTGHSFQIVRDDMLCAGSENHDSCQGDSGGPLVCKVNGT

SEQ ID NO: 13718 - protein, 42 aa, Homo Sapiens
MVGKLKQNLLLACLVISSVTVFYLGQHAMECHHRIEERSQPV

SEQ ID NO: 13719 - protein, 140 aa, Homo Sapiens
MVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQA

SEQ ID NO: 13720 - protein, 370 aa, Homo Sapiens
MVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQAFLLEIIVKHGEPAPYLCNKDPFALKSLTYLSRLFPNAKFLLMVRDGRASVHSMISRKVTIAGFDLNSYRDCLTKWNRAIETMYNQCMEVGYKKCMLVHYEQLVLHPERWMRTLLKFLQIPWNHSVLHHEEMIGKAGGVSLSKVERSTDQVIKPVNVGALSKWVGKIPPDVLQDMAVIAPMLAKLGYDPYANPPNYGKPDPKIIENTRRVYKGEFQLPDFLKEKPQTEQVE

SEQ ID NO: 13721 - protein, 168 aa, Homo Sapiens
DFLGIAWSDAVLHHEDLIGKPGGVSLSKIERSTDQVIKPVNLEALSKWTGHIPGDVVRDMAQIAPMLAQLGYDPYANPPNYGNPDPFVINNTQRVSVHLYLWKCTLGDMGLLQMWKLQPPEEMFSLSIPGHLICSCLMDTVNYMIACISILLGLQGSSKPTGSLSLIL

SEQ ID NO: 13722 - protein, 47 aa, Homo Sapiens
MRLSVRRVLLAAGCALVLVLAVQLGQQVLECRAVLAGLRSPRGAMRP

SEQ ID NO: 13723 - protein, 48 aa, Homo Sapiens
MRLSVRRVLLAAGCALVLVLAVQLGQQVLECRAVLAGLRSPRGAMRPE

SEQ ID NO: 13724 - protein, 64 aa, Homo Sapiens
MRLSVRRVLLAAGCALVLVLAVQLGQQVLECRAVLAGLRSPRGAMRPEQEELVMVGTNHVEYRY

SEQ ID NO: 13725 - protein, 120 aa, Homo Sapiens
MRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREK

SEQ ID NO: 13726 - protein, 142 aa, Homo Sapiens
MRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREKLRLDEAGVTDEVLDAAMQAFIL

SEQ ID NO: 13727 - protein, 377 aa, Homo Sapiens
MRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREKLRLDEAGVTDEVLDAAMQAFILEVIAKHGEPARVLCNKDPFTLKSSVYLSRLFPNSKFLLMVRDGRASVHSMITRKVTIAGFDLSSYRDCLTKWNKAIEVMYAQCMEVGKEKCLPVYYEQLVLHPRRSLKLILDFLGIAWSDAVLHHEDLIGKPGGVSLSKIERSTDQVIKPVNLEALSKWTGHIPGDVVRDMAQIAPMLAQLGYDPYANPPNYGNPDPFVINNTQRVLKGDYKTPANLKGYFQVNQNSTSSHLGSS

SEQ ID NO: 13728 - protein, 377 aa, Homo Sapiens; identical to SEQ ID NO: 13727

SEQ ID NO: 13729 - protein, 377 aa, Homo Sapiens; identical to SEQ ID NO: 13727

SEQ ID NO: 13730 - protein, 333 aa, Homo Sapiens
MSPWSWFLLQTLCLLPTGAASRRGAPGTANCELKPQQSELNSFLWTIKRDPPSYFFGTIHVPYTRVWDFIPDNSKEAFLQSSIVYFELDLTDPYTISALTSCQMLPQGENLQDVLPRDIYCRLKRHLEYVKLMMPLWMTPDQRGKGLYADYLFNAIAGNWERKRPVWVMLMVNSLTEVDIKSRGVPVLDLFLAQEAERLRKQTGAVEKVEEQCHPLNGLNFSQVIFALNQTLLQQESLRAGSLQIPYTTEDLIKHYNCGDLSSVILSHDSSQVPNFINATLPPQERITAQEIDSYLRRELIYKRNERIGKRVKALLEEFPDKGFFFAFGAASQ

SEQ ID NO: 13731 - protein, 505 aa, Homo Sapiens
MSPWSWFLLQTLCLLPTGAASRRGAPGTANCELKPQQSELNSFLWTIKRDPPSYFFGTIHVPYTRVWDFIPDNSKEAFLQSSIVYFELDLTDPYTISALTSCQMLPQGENLQDVLPRDIYCRLKRHLEYVKLMMPLWMTPDQRGKGLYADYLFNAIAGNWERKRPVWVMLMVNSLTEVDIKSRGVPVLDLFLAQEAERLRKQTGAVEKVEEQCHPLNGLNFSQVIFALNQTLLQQESLRAGSLQIPYTTEDLIKHYNCGDLSSVILSHDSSQVPNFINATLPPQERITAQEIDSYLRRELIYKRNERIGKRVKALLEEFPDKGFFFAFGAGHFMGNNTVLDVLRREGYEVEHAPAGRPIHKGKSKKTSTRPTLSTIFAPKVPTLEVPAPEAVSSGHSTLPPLVSRPGSADTPSEAEQRFRKKRRRSQRRPRLRQFSDLWVRLEESDIVPQLQVPVLDRHISTELRLPRRGHSHHSQMVASSACLSLWTPVFWVLVLAFQTETPLL

SEQ ID NO: 13732 - protein, 456 aa, Homo Sapiens
MSPWSWFLLQTLCLLPTGAASRRGAPGTANCELKPQQSELNSFLWTIKRDPPSYFFGTIHVPYTRVWDFIPDNSKEAFLQSSIVYFELDLTDPYTISALTSCQMLPQGENLQDVLPRDIYCRLKRHLEYVKLMMPLWMTPDQRGKGLYADYLFNAIAGNWERKRPVWVMLMVNSLTEVDIKSRGVPVLDLFLAQEAERLRKQTGAVEKVEEQCHPLNGLNFSQVPNFINATLPPQERITAQEIDSYLRRELIYKRNERIGKRVKALLEEFPDKGFFFAFGAGHFMGNNTVLDVLRREGYEVEHAPAGRPIHKGKSKKTSTRPTLSTIFAPKVPTLEVPAPEAVSSGHSTLPPLVSRPGSADTPSEAEQRFRKKRRRSQRRPRLRQFSDLWVRLEESDIVPQLQVPVLDRHISTELRLPRRGHSHHSQMVASSACLSLWTPVFWVLVLAFQTETPLL

SEQ ID NO: 13733 - protein, 517 aa, Homo Sapiens
MHAALAGPLLAALLATARARPQPPDGGQCRPPGSQRDLNSFLWTIRRDPPAYLFGTIHVPYTRVWDFIPDNSKAAFQASTRVYFELDLTDPYTISALASCQLLPHGENLQDVLPHELYWRLKRHLDYVKLMMPSWMTPAQRGKGLYADYLFNAIAGNWERKRPVWVMLMVNSLTERDVRFRGVPVLDLYLAQQAEKMKKTTGAVEQVEEQCHPLNNGLNFSQVLFALNQTLLQQESVRAGSLQASYTTEDLIKHYNCGDLSAVIFNHDTSQLPNFINTTLPPHEQVTAQEIDSYFRQELIYKRNERMGKRVMALLRENEDKICFFAFGAGHFLGNNTVIDILRQAGLEVDHTPAGQAIHSPAPQSPAPSPEGTSTSPAPVTPAAAVPEAPSVTPTAPPEDEDPALSPHLLLPDSLSQLEEFGRQRKWHKRQSTHQRPRQFNDLWVRIEDSTTASPPPLPLQPTHSSGTAKPPFQLSDQLQQQDPPGPASSSAPTLGLLPAIATTIAVCFLLHSLGPS

SEQ ID NO: 13734 - protein, 37 aa, Homo Sapiens
MPGRTWELCLLLLLGLGLGSQEALPPPCERTSPADLH

SEQ ID NO: 13735 - protein, 552 aa, Homo Sapiens
MPGRTWELCLLLLLGLGLGSQEALPPPCESEIYCHGELLNQVQMAKLYQDDKQFVDMPLSIAPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYCYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWTNGVVLMLLDRYGDRLTSGAKLAFLEPHCLAATLLPSLLLSLLPW

SEQ ID NO: 13736 - protein, 583 aa, Homo Sapiens
MPGRTWELCLLLLLGLGLGSQEALPPPCESEIYCHGELLNQVQMAKLYQDDKQFVDMPLSIAPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYWDSYWVMEGLLLSEMAETVKGMLQNFLDLVKTYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWTNGVVLMLLDRYGDRLTSGAKLAFLEPHCLAATLLPSLLLSLLPW

SEQ ID NO: 13737 - protein, 150 aa, Homo Sapiens
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFRCSTLSFSWLVDS

SEQ ID NO: 13738 - protein, 250 aa, Homo Sapiens
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIREKSMTFGIRRLDVESHPLPPLHTGHFRISQFFSQAGTQSLHSCYKGKPTP

SEQ ID NO: 13739 - protein, 234 aa, Homo Sapiens
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRVPVFNIVILLAGGFLSKSLVFSVLFAVTLRSFVP

SEQ ID NO: 13740 - protein, 225 aa, Homo Sapiens
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRYSFQVPGPLVWTLSPLFPSLCAERM

SEQ ID NO: 13741 - protein, 219 aa, Homo Sapiens
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRAERHVKEDDGRKSPGEVPPGTSPACILATWPPGLLVLLWQETTLPEHCFSWTLEAGTG

SEQ ID NO: 13742 - protein, 222 aa, Homo Sapiens
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRPSQGSHLPSCLSKEPLGRRNPLPTHFHPSPPGLHLSHQDSSSQRPLGCSLAWTEARDTSTQ

SEQ ID NO: 13743 - protein, 230 aa, Homo Sapiens
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRSLLEGEIPFPPTSILLLLACIFLIKILAASALWAAAWHGQKPGTHPPSELDCGHDPGYQLQTLPGLRDT

SEQ ID NO: 13744 - protein, 238 aa, Homo Sapiens
MPGPWLLLALALTLNLTGVPGGRAQPEAAQQEAVTAAEHPGLDDFLRQVERLLFLRENIQRLQGDQASQIFQSDWLSKRQHPGKREEEEEEGVEEEEEEEGGAVGPHKRQHPGRREDEASWSVDVTQHKRQHPGRRSPWLAYAVPKRQHPGRRLADPKAQRSWEEEEEEEEREEDLMPEKRQHPGKRALGGPCGPQGAYGQAGLLLGLLDDLSRSQGAEEKRQHPGRRAAWVREPLEE

SEQ ID NO: 13745 - protein, 242 aa, Homo Sapiens
MPGPWLLLALALTLNLTGVPGGRAQPEAAQQEAVTAAEHPGLDDFLRQVERLLFLRENIQRLQGDQGEHSASQIFQSDWLSKRQHPGKREEEEEEGVEEEEEEEGGAVGPHKRQHPGRREDEASWSVDVTQHKRQHPGRRSPWLAYAVPKRQHPGRRLADPKAQRSWEEEEEEEEREEDLMPEKRQHPGKRALGGPCGPQGAYGQAGLLLGLLDDLSRSQGAEEKRQHPGRRAAWVREPLEE

SEQ ID NO: 13746 - protein, 1050 aa, Homo Sapiens
MEVAVEKAVAAAAAASAAASGGPSAAPSGENEAESRQGPDSERGGEAARLNLLDTCAVCHQNIQSRAPKLLPCLHSFCQRCLPAPQRYLMLPAPMLGSAETPPPVPAPGSPVSGSSPFATQVGVIRCPVCSQECAERHIIDNFFVKDTTEVPSSTVEKSNQVCTSCEDNAEANGFCVECVEWLCKTCIRAHQRVKFTKDHTVRQKEEVSPEAVGVTSQRPVFCPFHKKEQLKLYCETCDKLTCRDCQLLEHKEHRYQFIEEAFQNQKVIIDTLITKLMEKTKYIKFTGNQIQNRIIEVNQNQKQVEQDIKVAIFTLMVEINKKGKALLHQLESLAKDHRMKLMQQQQEVAGLSKQLEHVMHFSKWAVSSGSSTALLYSKRLITYRLRHLLRARCDASPVTNNTIQFHCDPSFWAQNIINLGSLVIEDKESQPQMPKQNPVVEQNSQPPSGLSSNQLSKFPTQISLAQLRLQHMQQQVMAQRQQVQRRPAPVGLPNPRMQGPIQQPSISHQQPPPRLINFQNHSPKPNGPVLPPHPQQLRYPPNQNIPRQAIKPNPLQMAFLAQQAIKQWQISSGQGTPSTTNSTSSTPSSPTITSAAGYDGKAFGSPMIDLSSPVGGSYNLPSLPDIDCSSTIMLDNIVRKDTNIDHGQPRPPSNRTVQSPNSSVPSPGLAGPVTMTSVHPPIRSPSASSVGSRGSSGSSSKPAGADSTHKVPVVMLEPIRIKQENSGPPENYDFPVVIVKQESDEESRPQNANYPRSILTSLLLNSSQSSTSEETVLRSDAPDSTGDQPGLHQDNSSNGKSEWLDPSQKSPLHVGETRKEDDPNEDWCAVCQNGGELLCCEKCPKVFHLSCHVPTLTNFPSGEWICTFCRDLSKPEVEYDCDAPSHNSEKKKTEGLVKLTPIDKRKCERLLLFLYCHEMSLAFQDPVPLTVPDYYKIIKNPMDLSTIKKRLQEDYSMYSKPEDFVADFRLIFQNCAEFNEPDSEVANAGIKLENYFEELLKNLYPEKRFPKPEFRNESEDNKFSDDSDDDFVQPRKKRLKSIEERQLLK

SEQ ID NO: 13747 - protein, 1016 aa, Homo Sapiens
MEVAVEKAVAAAAAASAAASGGPSAAPSGENEAESRQGPDSERGGEAARLNLLDTCAVCHQNIQSRAPKLLPCLHSFCQRCLPAPQRYLMLPAPMLGSAETPPPVPAPGSPVSGSSPFATQVGVIRCPVCSQECAERHIIDNFFVKDTTEVPSSTVEKSNQVCTSCEDNAEANGFCVECVEWLCKTCIRAHQRVKFTKDHTVRQKEEVSPEAVGVTSQRPVFCPFHKKEQLKLYCETCDKLTCRDCQLLEHKEHRYQFIEEAFQNQKVIIDTLITKLMEKTKYIKFTGNQIQNRIIEVNQNQKQVEQDIKVAIFTLMVEINKKGKALLHQLESLAKDHRMKLMQQQQEVAGLSKQLEHVMHFSKWAVSSGSSTALLYSKRLITYRLRHLLRARCDASPVTNNTIQFHCDPSFWAQNIINLGSLVIEDKESQPQMPKQNPVVEQNSQPPSGLSSNQLSKFPTQISLAQLRLQHMQQQQPPPRLINFQNHSPKPNGPVLPPHPQQLRYPPNQNIPRQAIKPNPLQMAFLAQQAIKQWQISSGQGTPSTTNSTSSTPSSPTITSAAGYDGKAFGSPMIDLSSPVGGSYNLPSLPDIDCSSTIMLDNIVRKDTNIDHGQPRPPSNRTVQSPNSSVPSPGLAGPVTMTSVHPPIRSPSASSVGSRGSSGSSSKPAGADSTHKVPVVMLEPIRIKQENSGPPENYDFPVVIVKQESDEESRPQNANYPRSILTSLLLNSSQSSTSEETVLRSDAPDSTGDQPGLHQDNSSNGKSEWLDPSQKSPLHVGETRKEDDPNEDWCAVCQNGGELLCCEKCPKVFHLSCHVPTLTNFPSGEWICTFCRDLSKPEVEYDCDAPSHNSEKKKTEGLVKLTPIDKRKCERLLLFLYCHEMSLAFQDPVPLTVPDYYKIIKNPMDLSTIKKRLQEDYSMYSKPEDFVADFRLIFQNCAEFNEPDSEVANAGIKLENYFEELLKNLYPEKRFPKPEFRNESEDNKFSDDSDDDFVQPRKKRLKSIEERQLLK

SEQ ID NO: 13748 - protein, 460 aa, Homo Sapiens
IYFQLHRALKMIVDPVEPHGEMKFQWDLNAWTKSAEAFGKIVAERPGTNSTGPAPMAPPRAPGPLSKQGSGSSQPMEVQEGYGFGSEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 13749 - protein, 753 aa, Homo Sapiens
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQKVTEGQQERLERQHWTMTKIQKHQEHILRFASWALESDNNTALLLSKKLIYFQLHRALKMIVDPVEPHGEMKFQWDLNAWTKSAEAFGKIVAERPGTNSTGPAPMAPPRAPGPLSKQGSGSSQPMEVQEGYGFGSGDDPYSSAEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 13750 - protein, 835 aa, Homo Sapiens
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTVVDCPVCKQQCFSKDIVENYFMRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQKVTEGQQERLERQHWTMTKIQKHQEHILRFASWALESDNNTALLLSKKLIYFQLHRALKMIVDPVEPHGEMKFQWDLNAWTKSAEAFGKIVAERPGTNSTGPAPMAPPRAPGPLSKQGSGSSQPMEVQEGYGFGSGDDPYSSAEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 13751 - protein, 61 aa, Homo Sapiens
MRDSGSKAATDAQDANQCCTSCEDNAPATSYCVECSEPLCETCVEAHQRVKYTKDHTVRST

SEQ ID NO: 13752 - protein, 178 aa, Homo Sapiens
MRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRV

SEQ ID NO: 13753 - protein, 162 aa, Homo Sapiens
MRLGAQRPASVWSGGGAERGITLYKVVDCPVCKQQCFSKDIVENYFMRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVR

SEQ ID NO: 13754 - protein, 2546 aa, Homo Sapiens
IKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSGTSTPGPSLPPPGAAPEAGPSAPSRRPPGADAEGSEREAEPIPKMKVLESPRKGAANASGSSPDAPAKDARASLGTLPLGKPRAGAASPLNSPLSSAVPSLGKEPFPPSSPLQKGGSFWSSIPASPASRPGSFTFPGDSDSLQRQTPRHAAPGKDTDRMSTCSSASEQSVQSTQSNGSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRANWNNWSPY

SEQ ID NO: 13755 - protein, 1508 aa, Homo Sapiens
MAEGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFVSIGVQNCKSKGNTIAVFL

SEQ ID NO: 13756 - protein, 255 aa, Homo Sapiens
MALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGRVVALCHRFKETFREICWF

SEQ ID NO: 13757 - protein, 2309 aa, Homo Sapiens
MKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSE

SEQ ID NO: 13758 - protein, 596 aa, Homo Sapiens
MLPSQAQGLLWWVFPLFPASSLSYPPVSYRADGLARNTFLKACSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 13759 - protein, 458 aa, Homo Sapiens
MPNGLKPVDTLDSLSSVSSAYCSGGQPGTCKYWILDLDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFD

SEQ ID NO: 13760 - protein, 3097 aa, Homo Sapiens
MSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSGTSTPGPSLPPPGAAPEAGPSAPSRRPPGADAEGSEREAEPIPKMKVLESPRKGAANASGSSPDAPAKDARASLGTLPLGKPRAGAASPLNSPLSSAVPSLGKEPFPPSSPLQKGGSFWSSIPASPASRPGSFTFPGDSDSLQRQTPRHAAPGKDTDRMSTCSSASEQSVQSTQSNGSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 13761 - protein, 227 aa, Homo Sapiens
MPGCRISACGPGAQEGTAEQRSPPPPWDPMPSSQPPPPTPTLTPTPTPGQSPPLPDAAGASAGAAEDQELQRWRQGASGIAGLAGPGGGSGAAAGAGGRALELAEARRRLLEVEGRRRLVSELESRVLQLHRVFLAAELRLAHRAESLSRLSGGVAQAELYLAAHGSRLKKGPRRGRRGRPPALLASALGLGGCVPWGAGRLRRGHGPEPDSPFRRSPPRGPASPQR

SEQ ID NO: 13762 - protein, 50 aa, Homo Sapiens
  misc_feature (1)..(1): Xaa can be any naturally occurring amino acid
XGRPPALLASALGLGGCVPWGAGRLRRGHGPEPDSPFRRSPPRGPASPQR

SEQ ID NO: 13763 - protein, 156 aa, Homo Sapiens
MRLRMELGAPEEMGQVPPLDSRPSSPALYFTHDASLVHKSPDPFGAVAAQKFSLAHSMLAISGHLDSDDDSGSGSLVGIDNKIEQAMDLVKSHLMFAVREEVEVLKEQIRELAERNAALEQENGLLRALASPEQLAQLPSSGVPRLGPPAPNGPSV

SEQ ID NO: 13764 - protein, 395 aa, Homo Sapiens
MSGGKKKSSFQITSVTTDYEGPGSPGASDPPTPQPPTGPPPRLPNGEPSPDPGGKGTPRNGSPPPGAPSSRFRVVKLPHGLGEPYRRGRWTCVDVYERDLEPHSFGGLLEGIRGASGGAGGRSLDSRLELASLGLGAPTPPSGLSQGPTSWLRPPPTSPGPQARSFTGGLGQLVVPSKAKAEKPPLSASSPQQRPPEPETGESAGTSRAATPLPSLRVEAEAGGSGARTPPLSRRKAVDMRLRMELGAPEEMGQVPPLDSRPSSPALYFTHDASLVHKSPDPFGAVAAQKFSLAHSMLAISGHLDSDDDSGSGSLVGIDNKIEQAMDLVKSHLMFAVREEVEVLKEQIRELAERNAALEQENGLLRALASPEQLAQLPSSGVPRLGPPAPNGPSV

SEQ ID NO: 13765 - protein, 168 aa, Homo Sapiens
  misc_feature (1)..(1): Xaa can be any naturally occurring amino acid
XHCLLSACLAPARPCSARGALSPPGIPFTASLSIGGVSKDPFPLGMAQPGVSVKSLVSSYETRVVGMAPGLPRKRGCASSPCSPRGASPIRGTSGPPPHRGLGGPGQRPSTRRGMDKTLLSLILYCHSGSGSLVGIDNKIEQAMPSRHWAGDEAPTPLTLCLSRGPQD

SEQ ID NO: 13766 - protein, 211 aa, Homo Sapiens
  misc_feature (1)..(1): Xaa can be any naturally occurring amino acid
XLLSACLAPARPCSARGALSPPGIPFTASLSIGGVSKDPFPLGMAQPGVSVKSLVSSYETRVVGMAPGLPRKRGCASSPCSPRGASPIRGTSGPPPHRGLGGPGQRPSTRRGMDKTLLSLILYCHSGSGSLVGIDNKIEQAMDLVKSHLMFAVREEVEVLKEQIRELAERNAALEQENGLLRALASPEQLAQLPSSGVPRLGPPAPNGPSV

SEQ ID NO: 13767 - protein, 138 aa, Homo Sapiens
MTALFLMSMLFGLTCGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSV

SEQ ID NO: 13768 - protein, 138 aa, Homo Sapiens; identical to SEQ ID NO: 13767

SEQ ID NO: 13769 - protein, 231 aa, Homo Sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLL

SEQ ID NO: 13770 - protein, 764 aa, Homo Sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHEMRQGLHNMEDVYELIENSHLTPKKQGQISEEYMQTVL

SEQ ID NO: 13771 - protein, 764 aa, Homo Sapiens; identical to SEQ ID NO: 13770

SEQ ID NO: 13772 - protein, 253 aa, Homo Sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLLPLGRKSLSFETQKAPRSSMPS

SEQ ID NO: 13773 - protein, 274 aa, Homo Sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLVENVAVSGKGFCKSLFSWLYRLPLGRKSLSFETQKAPRSSMPS

SEQ ID NO: 13774 - protein, 112 aa, Homo Sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHITDTDAL

SEQ ID NO: 13775 - protein, 89 aa, Homo Sapiens
MRPADLLQLVLLLDLPRDLGGMGCSSPPCECHQEEDFRVTCKDIQRIPSLPPSTQTLYWRRERKKVWELEIKFNIEGDILNPSQEERKS

SEQ ID NO: 13776 - protein, 399 aa, Homo Sapiens
  misc_feature (1)..(1): Xaa can be any naturally occurring amino acid
XGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHEMRQGLHNMEDVYELIENSHLTPKKQGQISEEYMQTVL

SEQ ID NO: 13777 - protein, 105 aa, Homo Sapiens
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSISPTAFS

SEQ ID NO: 13778 - protein, 150 aa, Homo Sapiens
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSISPTAFSRLRYLESLDLSHNGLTALPAESFTSSPLSDVNLSHNQLREVSVSA

SEQ ID NO: 13779 - protein, 353 aa, Homo Sapiens
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSISPTAFSRLRYLESLDLSHNGLTALPAESFTSSPLSDVNLSHNQLREVSVSAFTTHSQGRALHVDLSHNLIHRLVPHPTRAGLPAPTIQSLNLAWNRLHAVPNLRDLPLRYLSLDGNPLAVIGPGAFAGLGGLTHLSLASLQRLPELAPSGFRELPGLQVLDLSGNPKLNWAGAEVFSGLSSLQELDLSGTNLVPLPEALLLHLPALQSVSVGQDVRCRRLVREGTYPRRPGSSPKVALHCVDTRDSAARGPTIL

SEQ ID NO: 13780 - protein, 353 aa, Homo Sapiens; identical to SEQ ID NO: 13779

SEQ ID NO: 13781 - protein, 353 aa, Homo Sapiens; identical to SEQ ID NO: 13779

SEQ ID NO: 13782 - protein, 63 aa, Homo Sapiens
MFAMKTKAALAIWCPGYSETQINATQAMKKRRKRKVTTNKCLEQVSQLQGLWRRFNRPLLKQQ

SEQ ID NO: 13783 - protein, 159 aa, Homo Sapiens
MFPFALLYVLSVSFRKIFILQLVGLVLTYDFTNCDFEKIKAAYLSTISKDLITYMSGTKSTEFNNTVSCSNRPHCLTEIQSLTFNPTAGCASLAKEMFAMKTKAALAIWCPGYSETQINATQAMKKRRKRKVTTNKCLEQVSQLQGLWRRFNRPLLKQQ

SEQ ID NO: 13784 - protein, 159 aa, Homo Sapiens
MKCLGQSKKEEVSFRKIFILQLVGLVLTYDFTNCDFEKIKAAYLSTISKDLITYMSGTKSTEFNNTVSCSNRPHCLTEIQSLTFNPTAGCASLAKEMFAMKTKAALAIWCPGYSETQINATQAMKKRRKRKVTTNKCLEQVSQLQGLWRRFNRPLLKQQ

SEQ ID NO: 13785 - protein, 189 aa, Homo Sapiens
MGQCGITSSKTVLVFLNLIFWFVIILLLVFVTEVVVVVLGYVYRAKVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQLLGMLCACIVLCRRSRDPAYELLITGGTYA

SEQ ID NO: 13786 - protein, 253 aa, Homo Sapiens
MGQCGITSSKTVLVFLNLIFWGAAGILCYVGAYVFITYDDYDHFFEDVYTLIPAVVIIAVGALLFIIGLIGCCATIRESRCGLATFVIILLLVFVTEVVVVVLGYVYRAKVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQLLGMLCACIVLCRRSRDPAYELLITGGTYA

SEQ ID NO: 13787 - protein, 228 aa, Homo Sapiens
MGQCGITSSKTVLVFLNLIFWGAAGILCYVGAYVFITYDDYDHFFEDVYTLIPAVVIIAVGALLFIIGLIGCCATIRESRCGLATVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQLLGMLCACIVLCRRSRDPAYELLITGGTYA

SEQ ID NO: 13788 - protein, 164 aa, Homo Sapiens
MGQCGITSSKTVLVFLNLIFWVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQLLGMLCACIVLCRRSRDPAYELLITGGTYA

SEQ ID NO: 13789 - protein, 45 aa, Homo Sapiens
MMHVIWAALAFAAIQLLGMLCACIVLCRRSRDPAYELLITGGTYA

SEQ ID NO: 13790 - protein, 45 aa, Homo Sapiens; identical to SEQ ID NO: 13789

SEQ ID NO: 13791 - protein, 72 aa, Homo Sapiens
MIILGLVFIFQFVISCSCLAINRSKQTDVINASWWVMSNKTRDELERSFDCCGLFNLTTLYQQDYDFCTAIC

SEQ ID NO: 13792 - protein, 86 aa, Homo Sapiens
MIILGLVFIFQFVISCSCLAINRSKQTDVINASWWVMSNKTRDELERSFDCCGLFNLTTLYQQDYDFCTAICKSQSPTCQMCGEKF

SEQ ID NO: 13793 - protein, 126 aa, Homo Sapiens
MVCGGFACSKNALCALNVVYMLVSLLLIGVAAWGKGLGLVSSIHIIGGVIAVGVFLLLIAVAGLICKSQSPTCQMCGEKFLKHSDEALKILGGVGLFFSFTEILGVWLAMRFRNQKDPRANPSAFL

SEQ ID NO: 13794 - protein, 128 aa, Homo Sapiens
MVCGGFACSKNALCALNVVYMLVSLLLIGVAAWGKGLGLVSSIHIIGGVIAVGVFLLLIAVAGLVGAVNHHQVLLFFYMIILGLVFIFQFVISCSCLAINRSKQIILRCTASGLLGYLLPLGCLVNFP

SEQ ID NO: 13795 - protein, 113 aa, Homo Sapiens
MVCGGFACSKNALCALNVVYMLVSLLLIGVAAWGKGLGLVSSIHIIGGVIAVGVFLLLIAVAGLVGAVNHHQVLLFFYMIILGLVFIFQFVISCSCLAINRSKQMSSMLLGGS

SEQ ID NO: 13796 - protein, 210 aa, Homo Sapiens
MVCGGFACSKNALCALNVVYMLVSLLLIGVAAWGKGLGLVSSIHIIGGVIAVGVFLLLIAVAGLVGAVNHHQVLLFFYMIILGLVFIFQFVISCSCLAINRSKQTDVINASWWVMSNKTRDELERSFDCCGLFNLTTLYQQDYDFCTAICKSQSPTCQMCGEKFLKHSDEALKILGGVGLFFSFTEILGVWLAMRFRNQKDPRANPSAFL

SEQ ID NO: 13797 - protein, 127 aa, Homo Sapiens
MVCGGFACSKNALCALNVVYMTDVINASWWVMSNKTRDELERSFDCCGLFNLTTLYQQDYDFCTAICKSQSPTCQMCGEKFLKHSDEALKILGGVGLFFSFTEILGVWLAMRFRNQKDPRANPSAFL

SEQ ID NO: 13798 - protein, 38 aa, Homo Sapiens
MSALLSLCFVLPLAAPGHGTQGWEPCTACSSLKAWAEC

SEQ ID NO: 13799 - protein, 669 aa, Homo Sapiens
MSALLSLCFVLPLAAPGHGTQGWEPCTDLRPLDILAEVVPSDGATSGIRIVQVHGARGLQLSVAAPRTMSFPASRIFSQCDLFPEEFSIVVTLRVPNLPPKRNEYLLTVVAEESDLLLLGLRLSPAQLHFLFLREDTAGAWQTRVSFRSPALVDGRWHTLVLAVSAGVFSLTTDCGLPVDIMADVPFPATLSVKGARFFVGSRRRAKGLFMGLVRQLVLLPGSDATPRLCPSRNAPLAVLSIPRVLQALTGKPEDNEVLKYPYETNIRVTLGPQPPCTEVEDAQFWFDASRKGLYLCVGNEWVSVLAAKERLDYVEEHQNLSTNSETLGIEVFRIPQVGLFVATANRKATSAVYKWTEEKFVSYQNIPTHQAQAWRHFTIGKKIFLAVANFEPDEKGQEFSVIYKWSHRKLKFTPYQSIATHSARDWEAFEVDGEHFLAVANHREGDNHNIDSVIYKWNPATRLFEANQTIATSGAYDWEFFSVGPYSFLVVANTFNGTSTKVHSHLYIRLLGSFQLFQSFPTFGAADWEVFQIGERIFLAVANSHSYDVEMQVQNDSYVINSVIYELNVTAQAFVKFQDILTCSALDWEFFSVGEDYFLVVANSFDGRTFSVNSIIYRWQGYEGFVAVHSLPTVGCRDWEAFSTTAGAYLIYSSAKEPLSRVLRLRTR

SEQ ID NO: 13800 - protein, 669 aa, Homo Sapiens; identical to SEQ ID NO: 13799

SEQ ID NO: 13801 - protein, 601 aa, Homo Sapiens
MSFPASRIFSQCDLFPEEFSIVVTLRVPNLPPKRNEYLLTVVAEESDLLLLGLRLSPAQLHFLFLREDTAGAWQTRVSFRSPALVDGRWHTLVLAVSAGVFSLTTDCGLPVDIMADVPFPATLSVKGARFFVGSRRRAKGLFMGLVRQLVLLPGSDATPRLCPSRNAPLAVLSIPRVLQALTGKPEDNEVLKYPYETNIRVTLGPQPPCTEVEDAQFWFDASRKGLYLCVGNEWVSVLAAKERLDYVEEHQNLSTNSETLGIEVFRIPQVGLFVATANRKATSAVYKWTEEKFVSYQNIPTHQAQAWRHFTIGKKIFLAVANFEPDEKGQEFSVIYKWSHRKLKFTPYQSIATHSARDWEAFEVDGEHFLAVANHREGDNHNIDSVIYKWNPATRLFEANQTIATSGAYDWEFFSVGPYSFLVVANTFNGTSTKVHSHLYIRLLGSFQLFQSFPTFGAADWEVFQIGERIFLAVANSHSYDVEMQVQNDSYVINSVIYELNVTAQAFVKFQDILTCSALDWEFFSVGEDYFLVVANSFDGRTFSVNSIIYRWQGYEGFVAVHSLPTVGCRDWEAFSTTAGAYLIYSSAKEPLSRVLRLRTR

SEQ ID NO: 13802 - protein, 123 aa, Homo Sapiens
DIAVKWRRIADPDQPVLWLDQMPARSLSRGFNNHINLIRGQVINMRYLEYFEKILHFIKDRILVYHGANNPKGLLEVREALEKVHKVEDLLPIMKVTLASEWQSMFLEEKKTNSTFLKRTQNY

SEQ ID NO: 13803 - protein, 166 aa, Homo Sapiens
MAPAGCCCCCCFWGGAVAAAGAARRVLLLLLLGVLSAGLRPGALATEHYSPLSLLKQELQHRQQQEAPAGGGGCSPQSGDWGDQYSAECGAIAYVLIGSGLYDEAIRHFSTMLQILSPLGRINEAVNDLTKAIQLQPSARLYRHRGTLYFISEDYATAHEDFQQSL

SEQ ID NO: 13804 - protein, 860 aa, Homo Sapiens
MAPAGCCCCCCFWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELAIAYVLIGSGLYDEAIRHFSTMLQEEPDLVSAIYGRGIAYGKKGLHDIKNAELALFELSRVITLEPDRPEVFEQRAEILSPLGRINEAVNDLTKAIQLQPSARLYRHRGTLYFISEDYATAHEDFQQSLELNKNQPIAMLYKGLTFFHRGLLKEAIESFKEALKQKVDFIDAYKSLGQAYRELGNFEAATESFQKALLLNQNHVQTLQLRGMMLYHHGSLQEALKNFKRCLQLEPYNEVCQYMKGLSHVAMGQFYEGIKAQTKVMLNDPLPGQKASPEYLKVKYLREYSRYLHAHLDTPLTEYNIDVDLPGSFKDHWAKNLPFLIEDYEEQPGLQPHIKDVLHQNFESYKPEVQELICVADRLGSLMQYETPGFLPNKRIHRAMGLAALEVMQAVQRTWTNSKVRMNGKTRLMQWRDMFDIAVKWRRIADPDQPVLWLDQMPARSLSRGFNNHINLIRGQVINMRYLEYFEKILHFIKDRILVYHGANNPKGLLEVREALEKVHKVEDLLPIMKQFNTKTKDGFTVNTKVPSLKDQGKEYDGFTITITGDKVGNILFSVETQTTEERTQLYHAEIDALYKDLTAKGKVLILSSEFGEADAVCNLILSLVYYFYNLMPLSRGSSVIAYSVIVGALMASGKEVAGKIPKGKLVDFEAMTAPGSEAFSKVAKSWMNLKSISPSYKTLPSVSETFPTLRSMIEVLNTDSSPRCLKKL

SEQ ID NO: 13805 - protein, 806 aa, Homo Sapiens
MAPAGCCCCCCFWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELAIAYVLIGSGLYDEAIRHFSTMLQILSPLGRINEAVNDLTKAIQLQPSARLYRHRGTLYFISEDYATAHEDFQQSLELNKNQPIAMLYKGLTFFHRGLLKEAIESFKEALKQKVDFIDAYKSLGQAYRELGNFEAATESFQKALLLNQNHVQTLQLRGMMLYHHGSLQEALKNFKRCLQLEPYNEVCQYMKGLSHVAMGQFYEGIKAQTKVMLNDPLPGQKASPEYLKVKYLREYSRYLHAHLDTPLTEYNIDVDLPGSFKDHWAKNLPFLIEDYEEQPGLQPHIKDVLHQNFESYKPEVQELICVADRLGSLMQYETPGFLPNKRIHRAMGLAALEVMQAVQRTWTNSKVRMNGKTRLMQWRDMFDIAVKWRRIADPDQPVLWLDQMPARSLSRGFNNHINLIRGQVINMRYLEYFEKILHFIKDRILVYHGANNPKGLLEVREALEKVHKVEDLLPIMKFNTKTKDGFTVNTKVPSLKDQGKEYDGFTITITGDKVGNILFSVETQTTEERTQLYHAEIDALYKDLTAKGKVLILSSEFGEADAVCNLILSLVYYFYNLMPLSRGSSVIAYSVIVGALMASGKEVAGKIPKGKLVDFEAMTAPGSEAFSKVAKSWMNLKSISPSYKTLPSVSETFPTLRSMIEVLNTDSSPRCLKKL

SEQ ID NO: 13806 - protein, 255 aa, Homo Sapiens
MAPAGCCCCCCFWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELAIAYVLIGSGLYDEAIRHFSTMLQILSPLGRINEAVNDLTKAIQLQPSARLYRHRGTLYFISENEVESCAVIRQEPRNQRLLKAEEKSDFEELWRPSMLKLLNPSKKL

SEQ ID NO: 13807 - protein, 150 aa, Homo Sapiens
MAPAGCCCCCCFWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELDIY

SEQ ID NO: 13808 - protein, 186 aa, Homo Sapiens
  misc_feature (1)..(1): Xaa can be any naturally occurring amino acid
XWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELAIAYVLIGSGLYDEAIRHFSTMLQEAIESFKEALKQKVDFIDAYKSLGQA

SEQ ID NO: 13809 - protein, 149 aa, Homo Sapiens
GRGGSMFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKLSIMKDEPEEAELILHDALRLAYQTDNKKAITYTYDLINW

SEQ ID NO: 13810 - protein, 380 aa, Homo Sapiens
MFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKLSIMKDEPEEAELILHDALRLAYQTDNKKAITYTYDLMANLAFIRGQLENAEQLFKATMSYLLGGGMKQEDNAIIEISLKLASIYAAQNRQEFAVAGYEFCISTLEEKIEREKELAEDIMSVEEKANTHLLLGMCLDACARYLLFSKQPSQAQRMYEKALQISEEIQGERHPQTIVLMSDLATTLDAQGRFDEAYIYMQRASDLARQINHPELHMVLSNLAAVLMHRERYTQAKEIYQEALKQAKLKKDEISVQHIREELAELSKKSRPLTNSVKL

SEQ ID NO: 13811 - protein, 99 aa, Homo Sapiens
SKQPSQAQRMYEKALQISEEIQGERHPQTIVLMSDLATTLDAQGRFDEAYIYMQRASDLARQINHPELHMVLSNLAAVLMHRAATTVLGPSKEAKATLG

SEQ ID NO: 13812 - protein, 63 aa, Homo Sapiens
  misc_feature (1)..(1): Xaa can be any naturally occurring amino acid
XGERHPQTIVLMSDLATTLDAQGRFDEAYIYMQRASDLARQINHPELHMVLSNLAAVLMHRGR

SEQ ID NO: 13813 - protein, 166 aa, Homo Sapiens
  misc_feature (1)..(1): Xaa can be any naturally occurring amino acid
XQERVWPAVRRGRGGSMFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKVRRLRALRPAERGSLCERGLGVAAHYSLRLAEEWMEAPRVKLPRMS

SEQ ID NO: 13814 - protein, 172 aa, Homo Sapiens
  misc_feature (1)..(1): Xaa can be any naturally occurring amino acid
XRRVVGGQERVWPAVRRGRGGSMFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKVRRLRALRPAERGSLCERGLGVAAHYSLRLAEEWMEAPRVKLPRMS

SEQ ID NO: 13815 - protein, 239 aa, Homo Sapiens
MQRGALSPVLMLSAAPEPPPRPPPALSPPGSGPGSGSRHGSARPGPTPEPSGSLGAALDSSLRAAVAFKAEGQRCYREKKFREAIGKYHRALLQLKAAQGARPSGLPAPAPGPTSSPGPARLSEEQRRLVESTEVECYDSLTACLLQSELVNYERVREYCLKVLEKQQGNFKATYRAGIAFYHLGDYARALRYLQEARSREPTDTNVLRYIQLTQLKMNRCSLQREDSGAGSQTRDVIG

SEQ ID NO: 13816 - protein, 800 aa, Homo Sapiens
MAAAASVTGRVTWAASPMRSLGLGRRLSLPGPRLDAVTAAVNPSLSDHGNGLGRGTRGSGCSGGSLVADWGGGAAAAAAVALALAPALSTMRRGSSESELAARWEAEAVAAAKAAAKAEAEATAETVAEQVRVDAGAAGEPECKAGEEQPKVLAPAPAQPSAAEEGNTQVLQRPPPTLPPSKPKPVQGLCPHGKPRDKGRSCKRSSGHGSGENGSQRPVTVDSSKARTSLDALKISIRQLKWKEFPFGRRLPCDIYWHGVSFHDNDIFSGQVNKFPGMTEMVRKITLSRAVRTMQNLFPEEYNFYPRSWILPDEFQLFVAQVQMVKDDDPSWKPTFIVKPDGGCQGDGIYLIKDPSDIRLAGTLQSRPAVVQEYICKPLLIDKLKFDIRLYVLLKSLDPLEIYIAKDGLSRFCTEPYQEPTPKNLHRIFMHLTNYSLNIHSGNFIHSDSASTGSKRTFSSILCRLSSKGVDIKKVWSDIISVVIKTVIALTPELKVFYQSDIPTGRPGPTCFQILGFDILLMKNLKPILLEVNANPSMRIEHEHELSPGVFENVPSLVDEEVKVAVIRDTLRLMDPLKKKRENQSQQLEKPFAGKEDALDGELTSAPDCNANPEAHLPSICLKQVFPKYAKQFNYLRLVDRMANLFIRFLGIKGTMKLGPTGFRTFIRSCKLSSSSLSMAAVDILYIDITRRWNSMTLDQRDSGMCLQAFVEAFFFLAQRKFKMLPLHEQVASLIDLCEYHLSLLDEKRLVCGRGVPSGGRPPHRGPPQEPSPSAQPAGDNPPPRTSCANKLSHPRHTLS

SEQ ID NO: 13817 - protein, 538 aa, Homo Sapiens
MAAAASVTGRVTWAASPMRSLGLGRRLSLPGPRLDAVTAAVNPSLSDHGNGLGRGTRGSGCSGGSLVADWGGGAAAAAAVALALAPALSTMRRGSSESELAARWEAEAVAAAKAAAKAEAEATAETVAEQVRVDAGAAGEPECKAGEEQPKVLAPAPAQPSAAEEGNTQVLQRPPPTLPPSKPKPVQGLCPHGKPRDKGRSCKRSSGHGSGENGSQRPVTVDSSKARTSLDALKISIRQLKWKEFPFGRRLPCDIYWHGVSFHDNDIFSGQVNKFPGMTEMVRKITLSRAVRTMQNLFPEEYNFYPRSWILPDEFQLFVAQVQMVKDDDPSWKPTFIVKPDGGCQGDGIYLIKDPSDIRLAGTLQSRPAVVQEYICKPLLIDKLKFDIRLYVLLKSLDPLEIYIAKDGLSRFCTEPYQEPTPKNLHRIFMHLTNYSLNIHSGNFIHSDSASTGSKRTFSSILCRLSSKGVDIKKVWSDIISVVIKTVIALTPELKVFYQSDIPTGRPGPTCFQVTIASSQPAFPALTGLKRALWLRVG

SEQ ID NO: 13818 - protein, 239 aa, Homo Sapiens
  misc_feature (1)..(1): Xaa can be any naturally occurring amino acid
XSDHGNGLGRGTRGSGCSGGSLVADWGGGAAAAAAVALALAPALSTMRRGSSESELAARWEAEAVAAAKAAAKAEAEATAETVAEQVRVDAGAAGEPECKAGEEQPKVLAPAPAQPSAAEEGNTQVLQRPPPTLPPSKPKPVQGLCPHGKPRDKGRSCKRSSGHGSGENGSQRPVTVDSSKARTSLDALKISIRQLKWKEFPFGRRLPCDIYWHGVSFHDNDIFSGQVNKFPGSNGERR

SEQ ID NO: 13819 - protein, 122 aa, Homo Sapiens
  misc_feature (1)..(1): Xaa can be any naturally occurring amino acid
XSSGHGSGENGSQRPVTVDSSKARTSLDALKISIRQLKWKEFPFGRRLPCDIYWHGVSFHDNDIFSGQVNKFPGMTEMVRKITLSRAVRTMQNLFPEESTSANLSLSTSSSLIFVCMSYSSP

SEQ ID NO: 13820 - protein, 66 aa, Homo Sapiens
  misc_feature (1)..(1): Xaa can be any naturally occurring amino acid
XVTVDSSKARTSLDALKISIRQLKWKEFPFGRRLPCDIYWHGVSFHDNDIFSGQVNKFPGSNGERR

SEQ ID NO: 13821 - protein, 185 aa, Homo Sapiens
MASHRLLLLCLAGLVFVSEAGPTGTGESKCPLMVKVLDAVRGSPAINVAVHVFRKAADDTWEPFASGKTSESGELHGLTTEEEFVEGIYKVEIDTKSYWKALGISPFHEHAEVSIQTFESFETDGCHGNRIQTCSSWSELQTSGFHQNVDVVFTANDSGPRRYTIAALLSPYSYSTTAVVTNPKE

SEQ ID NO: 13822 - protein, 147 aa, Homo Sapiens
MASHRLLLLCLAGLVFVSEAGPTGTGESKCPLMVKVLDAVRGSPAINVAVHVFRKAADDTWEPFASGKTSESGELHGLTTEEEFVEGIYKVEIDTKSYWKALGISPFHEHAEVVFTANDSGPRRYTIAALLSPYSYSTTAVVTNPKE

SEQ ID NO: 13823 - protein, 139 aa, Homo Sapiens
MASHRLLLLCLAGLVFVSEAGPTGTGESKCPLMVKVLDAVRGSPAINVAVHVFRKAADDTWEPFASGKTSESGELHGLTTEEEFVEGIYKVEIDTKSYWKALGISPFHEHAEVVFTANDSGPRRYYSYSTTAVVTNPKE

SEQ ID NO: 13824 - protein, 75 aa, Homo Sapiens
MKLHYVAVLTLAILMFLTWLPESLSCNKALCASDVSKCLIQELCQCRPGEGNCSCCKECMLCLGALWDECCDCVD

SEQ ID NO: 13825 - protein, 223 aa, Homo Sapiens
MKLHYVAVLTLAILMFLTWLPESLSCNKALCASDVSKCLIQELCQCRPGEGNCSCCKECMLCLGALWDECCDCVGMCNPRNYSDTPPTSKSTVEELHEPIPSLFRALTEGDTQLNWNIVSFPVAEELSHHENLVSFLETVNQPHHQNVSVPSNNVHAPYSSDKEHMCTVVYFDDCMSIHQCKISCESMGASKYRWFHNACCECIGPECIDYGSKTVKCMNCMF

SEQ ID NO: 13826 - protein, 184 aa, Homo Sapiens
MKLHYVAVLTLAILMFLTWLPESLSCNKALCASDVSKCLIQELCQCRPGEGNCSCCKECMLCLGALWDECCDCVGMCNPRNYSDTPPTSKSTVEELHEPIPSLFRALTEGDTQLNWNIVSFPVAEELSHHENLVSFLETVNQPHHQNVSVPSNNVHAPYSSDKGNCQQLTFSIPPPHVVCPCNL

SEQ ID NO: 13827 - protein, 56 aa, Homo Sapiens
METRPRLGATCLLGFSFLLLVISSDGHNGLGKGFGDHIHWRTLEDGKKEAAARIHV

SEQ ID NO: 13828 - protein, 55 aa, Homo Sapiens
METRPRLGATCLLGFSFLLLVISSDGHNGLGKGFGDHIHWRTLEDGKKEAAARPY

SEQ ID NO: 13829 - protein, 172 aa, Homo Sapiens
METRPRLGATCLLGFSFLLLVISSDGHNGLGKGFGDHIHWRTLEDGKKEAAASGLPLMVIIHKSWCGACKALKPKFAESTEISELSHNFVMVNLEDEEEPKDEDFSPDGGYIPRILFLDPSGKVHPEIINENGNPSYKYFYVSAEQVVQGMKEAQERLTGDAFRKKHLEDEL

SEQ ID NO: 13830 - protein, 179 aa, Homo Sapiens
MKNRRETRETPGNPQLAVAEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMS

SEQ ID NO: 13831 - protein, 44 aa, Homo Sapiens
MVPAAGRRPPRVMRLLGWCCRGKWSLMVRGAACSPSPGGGCVPG

SEQ ID NO: 13832 - protein, 155 aa, Homo Sapiens
MVPAAGRRPPRVMRLLGWWQVLLWVLGLPVRGVEEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESD

SEQ ID NO: 13833 - protein, 44 aa, Homo Sapiens
MVPAAGRRPPRVMRLLGWWQVLLWVLGLPVRGVEGPYGFSEPKR

SEQ ID NO: 13834 - protein, 360 aa, Homo Sapiens
MVPAAGRRPPRVMRLLGWWQVLLWVLGLPVRGVEVAEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSSLSTRFGTVAVPNILLFQGAKPMARFNHTDRTLETLKIFIFNQTGIEAKKNVVVTQADQIGPLPSTLIKSVDWLLVFSLFFLISFIMYATIRTESIRWLIPGQEQEHVE

SEQ ID NO: 13835 - protein, 344 aa, Homo Sapiens
  misc_feature (1)..(1): Xaa can be any naturally occurring amino acid
XFPGVSWMEAGQQRVVEKVAEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSSLSTRFGTVAVPNILLFQGAKPMARFNHTDRTLETLKIFIFNQTGIEAKKNVVVTQADQIGPLPSTLIKSVDWLLVFSLFFLISFIMYATIRTESIRWLIPGQEQEHVE

SEQ ID NO: 13836 - protein, 115 aa, Homo Sapiens
  misc_feature (1)..(1): Xaa can be any naturally occurring amino acid
XLALDASQHSRFGTVAVPNILLFQGAKPMARFNHTDRTLETLKIFIFNQTGIEAKKNVVVTQADQIGPLPSTLIKSVDWLLVFSLFFLISFIMYATIRTESIRWLIPGQEQEHVE

SEQ ID NO: 13837 - protein, 324 aa, Homo Sapiens
MEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 13838 - protein, 432 aa, Homo Sapiens
MPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 13839 - protein, 500 aa, Homo Sapiens
MAAMAVALRGLGGRFRWRTQAVAGGVRGAARGAAAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCG

SEQ ID NO: 13840 - protein, 338 aa, Homo Sapiens
MAAMAVALRGLGGRFRWRTQAVAGGVRGAARGAAAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIAPCISACLPTTVGHAGKNQRRD

SEQ ID NO: 13841 - protein, 523 aa, Homo Sapiens
MAAMAVALRGLGGRFRWRTQAVAGGVRGAARGAAAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCG

SEQ ID NO: 13842 - protein, 463 aa, Homo Sapiens
MAAMAVALRGLGGRFRWRTQAVAGGVRGAARGAAAGQRDYDLLVVGGGSGGLACAKEGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIK

SEQ ID NO: 13843 - protein, 522 aa, Homo Sapiens
MAAMAVALRGLGGRFRWRTQAVAGGVRGAARGAAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCG

SEQ ID NO: 13844 - protein, 306 aa, Homo Sapiens
MEAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIAPCISACLPTTVGHAGKNQRRD

SEQ ID NO: 13845 - protein, 493 aa, Homo Sapiens
MEDQAGQRDYDLLVVGGGSGGLACAKEAAQLGRKVAVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCG

SEQ ID NO: 13846 - protein, 427 aa, Homo Sapiens
MHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCG

SEQ ID NO: 13847 - protein, 164 aa, Homo Sapiens
MKTGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCG

SEQ ID NO: 13848 - protein, 179 aa, Homo Sapiens
MKTVAGALLSLVMGQPSEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCG

SEQ ID NO: 13849 - protein, 211 aa, Homo Sapiens
MPLRRTSSRGNAGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCGMAAGQVWGASTLSWSACEMVSVERKCWTGGPCAPQGWL

SEQ ID NO: 13850 - protein, 361 aa, Homo Sapiens
QQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPIAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGCGMAAGQVWGASTLSWSACEMVSVERKCWTGGPCAPQGWLRGLSTSPLHLSASAAGHPPPGSWCQMMTTWVETYPVGTHVRAPWHFCNANKEGTFSE

SEQ ID NO: 13851 - protein, 171 aa, Homo Sapiens
  misc_feature (1)..(1): Xaa can be any naturally occurring amino acid
XGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGLPHPAGCQAGWPLPSAPREQP

SEQ ID NO: 13852 - protein, 247 aa, Homo Sapiens
MAQVPPPASGERHAGTEDGPIRRNPAGNVARPMVQRLPEPQDVAQCLEVGLFDTPPFYSNSTNSFRNTVEGYSDPTGKYDPAVRSLHNLAHLFLNGTGGQTHLSPNDPIFVLLHTFTDAVFDEWLRRYNADISTFPLENAPIGHNRQYNMVPFWPPVTNTEMFVTAPDNLGYTYEIQWPSREFSVPEIIAIAVVGALLLVALIFGTASYLIRARRSMDEANQPLLTDQYQCYAEEYEKLQNPNQSVV

SEQ ID NO: 13853 - protein, 102 aa, Homo Sapiens
MSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCN

SEQ ID NO: 13854 - protein, 537 aa, Homo Sapiens
MSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCNGNFSGHNCGTCRPGWRGAACDQRVLIVRRNLLDLSKEEKNHFVRALDMAKRTTHPLFVIATRRSEEILGPDGNTPQFENISIYNYFVWTHYYSVKKTFLGVGQESFGEVDFSHEGPAFLTWHRYHLLRLEKDMQEMLQEPSFSLPYWNFATGKNVCDICTDDLMGSRSNFDSTLISPNSVFSQWRVVCDSLEDYDTLGTLCNSTEDGPIRRNPAGNVARPMVQRLPEPQDVAQCLEVGLFDTPPFYSNSTNSFRNTVEGYSDPTGKYDPAVRSLHNLAHLFLNGTGGQTHLSPNDPIFVLLHTFTDAVFDEWLRRYNADISTFPLENAPIGHNRQYNMVPFWPPVTNTEMFVTAPDNLGYTYEIQWPSREFSVPEIIAIAVVGALLLVALIFGTASYLIRARRSMDEANQPLLTDQYQCYAEEYEKLQNPNQSVV

SEQ ID NO: 13855 - protein, 43 aa, Homo Sapiens
GGMINWNRLFPPLRQRQNVNYQGGRQSEPAAPPLEVSEEQTNE

SEQ ID NO: 13856 - protein, 309 aa, Homo Sapiens
MCFFFSLQEEFLDKHTLMRVLSSGGKLGSRGEGAQLCCWMLLFSWRVSGGQQTRRLCRRAFCWSPVPSPSCSPSSCLTARSSLCMTFTQSRTTSSLAPVFALFVPFYCSIPRVQVAQILGPLSITNKTLIYILGLQLFTSGSYIWIVAISGLMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 13857 - protein, 344 aa, Homo Sapiens
MFTSTGSSGLYKAPLSKSLLLVPSALSLLLALLLPHCQKLFVYDLHAVKNDFQIWRLICGRIICLDLKDTFCSSLLIYNFRIFERRYGSRKFASFLLGSWVLSALFDFLLIEAMQYFFGITAASNLPSGFLAPVFALFVPFYCSIPRVQVAQILGPLSITNKTLIYILGLQLFTSGSYIWIVAISGLMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 13858 - protein, 204 aa, Homo Sapiens
MFTSTGSSGLYKAPLSKSLLLVPSALSLLLALLLPHCQKLFVYDLHAVKNDFQMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVAT

SEQ ID NO: 13859 - protein, 135 aa, Homo Sapiens
MGTKPRRPPRPHLVSPDKAPLSKSLLLVPSALSLLLALLLPHCQKLFVYDLHAVKNDFQIWRLICGRIICLDLKDTFCSSLLIYNFRIFERRYGSRKFASFLLGSWVLSALFDFLLIEAMQYFFGITAASNLPSG

SEQ ID NO: 13860 - protein, 212 aa, Homo Sapiens
MKLLTLQPPGMLWLMERGGLGKPRGPRHRGLLRVRLGRFISRLLLWEPLGGGQAWGSGEGTQSLPRMGQPRISPWEAVGAPPGRGAHPISPLFPSQMCTPANTPATPPNFPDALTMFSRLKASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 13861 - protein, 52 aa, Homo Sapiens
MMCTPANTPATPPNFPDALTMFSRLKASESFHSGGSGSPMAATATSPPPHFP

SEQ ID NO: 13862 - protein, 117 aa, Homo Sapiens
MMCTPANTPATPPNFPDALTMFSRLKASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 13863 - protein, 67 aa, Homo Sapiens
MSVNMDELKHQRCCSLQRKGLWETPGLFPPPPSACLLGLPACLPCTWGYPHPLPFPLLTKEKNEFQT

SEQ ID NO: 13864 - protein, 156 aa, Homo Sapiens
MSVNMDELKHQVMINQFVLTAGCAADQAKQLLQAAHWQFEMCTPANTPATPPNFPDALTMFSRLKASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 13865 - protein, 94 aa, Homo Sapiens
MSVNMDELKHQVMINQFVLTAGCAADQAKQLLQAAHWQFESSQGHPQPQRSLGTRAAAGPAGAWRVSRGLSSCRQPSAPFSRRPTSPTATITTR

SEQ ID NO: 13866 - protein, 152 aa, Homo Sapiens
MSVNMDELKHQVMINQFVLTAGCAADQAKQLLQAAHWQFETALSAFFQETNIPYSHHHHQMASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 13867 - protein, 177 aa, Homo Sapiens
MSVNMDELKHQVMINQFVLTAGCAADQAKQLLQAAHWQFETALSAFFQETNIPYSHHHHQMMCTPANTPATPPNFPDALTMFSRLKASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 13868 - protein, 122 aa, Homo Sapiens
MSVNMDELKHQVMINQFVLTAGCAADQAKQLLQAAHWQFEVRGAGAGRGPGPRAECVPRGRRAGADGVDACRLCAPSGPQTRPAFPTAVPGVRIPRARGGRRQPSAPFSRRPTSPTATITTR

SEQ ID NO: 13869 - protein, 117 aa, Homo Sapiens
HNRIPYQSPVSSSESAPGTIMNGHGGGRSQQTLDTPKTTGPPSALPSVSSLPSTTSCTALLPSTSQHTGDLTSSPLSQLSSMPVWRAPLPTSPQPPSPRQRPPSQVPHPQAPACPVA

SEQ ID NO: 13870 - protein, 412 aa, Homo Sapiens
MMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKL

SEQ ID NO: 13871 - protein, 1119 aa, Homo Sapiens
MMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGASLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 13872 - protein, 1119 aa, Homo Sapiens; identical to SEQ ID NO: 13871

SEQ ID NO: 13873 - protein, 358 aa, Homo Sapiens
MNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 13874 - protein, 176 aa, Homo Sapiens
MRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRELASNTHNIAQDLSNKSSYGLKGAWKNSVEEWTTEDWTEDH

SEQ ID NO: 13875 - protein, 278 aa, Homo Sapiens
  misc_feature (1)..(1): Xaa can be any naturally occurring amino acid
XEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHL

SEQ ID NO: 13876 - protein, 270 aa, Homo Sapiens
MASRGVVGIFFLSAVPLVCLELRRGIPDIGIKDFLLLCGRILLLLALLTLTISVTTSWLNSFKSPQVYLKEEEEKNEKRQKLVRKKQQEAQGEKASRYIENVLKPHQEMKLRKLEERFYQMTGEAWKLSSGHKLGGDEGTSQTSFETSNREAAKSQNLPKPLTEFPSPAEQPTCKEIPDLPEEPSQTAEEVVTVALRCPSGNVLRRRFLKSYSSQVLFDWMTRIGYHISLYSLSTSFPRRPLAVEGGQSLEDIGITVDTVLILEEKEQTN

SEQ ID NO: 13877 - protein, 229 aa, Homo Sapiens
MASRGVVGIFFLSAVPLVCLELRRGIPDIGIKDFLLLCGRILLLLALLTLTISVTTSWLNSFKSPQVYLKEEEEKNEKRQKLVRKKQQEAQGEKGDEGTSQTSFETSNREAAKSQNLPKPLTEFPSPAEQPTCKEIPDLPEEPSQTAEEVVTVALRCPSGNVLRRRFLKSYSSQVLFDWMTRIGYHISLYSLSTSFPRRPLAVEGGQSLEDIGITVDTVLILEEKEQTN

SEQ ID NO: 13878 - protein, 42 aa, Homo Sapiens
MASRGVVGIFFLSAVPLVCLELRRGIPDIGKCDFFPSTVTAG

SEQ ID NO: 13879 - protein, 233 aa, Homo Sapiens
MASRGVVGIFFLSAVPLVCLELRRGIPDIVYLKEEEEKNEKRQKLVRKKQQEAQGEKASRYIENVLKPHQEMKLRKLEERFYQMTGEAWKLSSGHKLGGDEGTSQTSFETSNREAAKSQNLPKPLTEFPSPAEQPTCKEIPDLPEEPSQTAEEVVTVALRCPSGNVLRRRFLKSYSSQVLFDWMTRIGYHISLYSLSTSFPRRPLAVEGGQSLEDIGITVDTVLILEEKEQTN

SEQ ID NO: 13880 - protein, 248 aa, Homo Sapiens
MCQREKRWQLGVLTQTVGPWPRPVAYLSKQLDGVFKGWPPCLRALAATALLVQEADKLTLGQNRNIKAPHAVVTLMNTKGHHWLMSARLTKYQSLLCENPRITIEVCNTLNPATLFPVSESPVEHDCVEVLDSVYSSRPDLRDQPWASVDWELYVDGSSFINPQGERFAGYAVVTLDTVVEARSLPQGTSAQKAELIALIRALELSEGIKDFLLLCGRILLLLALLTLTISVTTSWLNSFKSPQVYLK

SEQ ID NO: 13881 - protein, 310 aa, Homo Sapiens
MLYSGTWRTVGIRCPRKKAQICQQQECCIERPPLRLRGFGAALTTTPRLHRPCPPTSGADFTSRNLFPPGIKDFLLLCGRILLLLALLTLTISVTTSWLNSFKSPQVYLKEEEEKNEKRQKLVRKKQQEAQGEKASRYIENVLKPHQEMKLRKLEERFYQMTGEAWKLSSGHKLGGDEGTSQTSFETSNREAAKSQNLPKPLTEFPSPAEQPTCKEIPDLPEEPSQTAEEVVTVALRCPSGNVLRRRFLKSYSSQVLFDWMTRIGYHISLYSLSTSFPRRPLAVEGGQSLEDIGITVDTVLILEEKEQTN

SEQ ID NO: 13882 - protein, 94 aa, Homo Sapiens
  misc_feature (1)..(1): Xaa can be any naturally occurring amino acid
XIKDFLLLCGRILLLLALLTLTISVTTSWLNSFKSPQVYLKEEEEKNEKRQKLVRKKQQEAQGEKASRYIENVLKPHQEMKLRKLEERFYQMTG

SEQ ID NO: 13883 - protein, 138 aa, Homo Sapiens
MTWRQAVLLSCFSAVVLLSMLREGTSVSVGTMQMAGEEASEDAKQKIFMQESDASNFLKRRGKRSPKSRDEVNVENRQKLRVDELRREYYEEQRNEFENFVEEQNDEQEERSREAVEQWRQWHYDGLHPSYLYNRHHT

SEQ ID NO: 13884 - protein, 116 aa, Homo Sapiens
MTWRQAVLLSCFSAVVLLSNAKQKIFMQESDASNFLKRRGKRSPKSRDEVNVENRQKLRVDELRREYYEEQRNEFENFVEEQNDEQEERSREAVEQWRQWHYDGLHPSYLYNRHHT

SEQ ID NO: 13885 - protein, 124 aa, Homo Sapiens
MRQAGRAALLAALLLLVQLCPGSSQRSPEAAGVQDPSLRWSPGARNQGGGARALLLLLAERFPRRAGPGRLGLGTAGERPRRDNPSLSIDLTFHLLRTLLELARTQSQRERAEQNRIIFDSVGK

SEQ ID NO: 13886 - protein, 112 aa, Homo Sapiens
MTRCALLLLMVLMLGRVLVVPVTPIPTFQLRPQNSPQTTPRPAASESPSAAPTWPWAAQSHCSPTRHPGSRIVLSLDVPIGLLQILLEQARARAAREQATTNARILARVGHC

SEQ ID NO: 13887 - protein, 161 aa, Homo Sapiens
MLMPVHFLLLLLLLLGGPRTGLPHKFYKAKPIFSCLNTALSEAEKGQWEDASLLSKRSFHYLRSRDASSGEEEEGKEKKTFPISGARGGARGTRYRYVSQAQPRGKPRQDTAKSPHRTKFTLSLDVPTNIMNLLFNIAKAKNLRAQAAANAHLMAQIGRKK

SEQ ID NO: 13888 - protein, 1516 aa, Homo Sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDSIKLMKDISQNFPIKARSLTRIAVNQHMREEIKENQKDLQVRFKIQPGDARLFINGLRVDMDVYDAFSILDMLKLEGKMMNGLRNLGINGEDMSKFLKLNSHIWEYTYVLDIRHSSIMWINDLENDDLYITWPTSCQKLLKPVFPGSVPSIRRNFHNLVLFIDPAQEYTLDFIKLADVFYSHEVPLRIGFVFILNTDDEVDGANDAGVALWRAFNYIAEEFDISEAFISIVHMYQKVKKDQNILTVDNVKSVLQNTFPHANIWDILGIHSKYDEERKAGASFYKMTGLGPLPQALYNGEPFKHEEMNIKELKMAVLQRMMDASVYLQREVFLGTLNDRTNAIDFLMDRNNVVPRINTLILRTNQQYLNLISTSVTADVEDFSTFFFLDSQDKSAVIAKNMYYLTQDDESIISAVTLWIIADFDKPSGRKLLFNALKHMKTSVHSRLGIIYNPTSKINEENTAISRGILAAFLTQKNMFLRSFLGQLAKEEIATAIYSGDKIKTFLIEGMDKNAFEKKYNTVGVNIFRTHQLFCQDVLKLRPGEMGIVSNGRFLGPLDEDFYAEDFYLLEKITFSNLGEKIKGIVENMGINANNMSDFIMKVDALMSSVPKRASRYDVTFLRENHSVIKTNPQENDMFFNVIAIVDPLTREAQKMAQLLVVLGKIINMKIKLFMNCRGRLSEAPLESFYRFVLEPELMSGANDVSSLGPVAKFLDIPESPLLILNMITPEGWLVETVHSNCDLDNIHLKDTEKTVTAEYELEYLLLEGQCFDKVTEQPPRGLQFTLGTKNKPAVVDTIVMAHHGYFQLKANPGAWILRLHQGKSEDIYQIVGHEGTDSQADLEDIIVVLNSFKSKILKVKVKKETDKIKEDILTDEDEKTKGLWDSIKSFTVSLHKENKKEKDVLNIFSVASGHLYERFLRIMMLSVLRNTKTPVKFWLLKNYLSPTFKEVIPHMAKEYGFRYELVQYRWPRWLRQQTERQRIIWGYKILFLDVLFPLAVDKIIFVDADQIVRHDLKELRDFDLDGAPYGYTPFCDSRREMDGYRFWKTGYWASHLLRRKYHISALYVVDLKKFRRIGAGDRLRSQYQALSQDPNSLSNLDQDLPNNMIYQVAIKSLPQDWLWCETWCDDESKQRAKTIDLCNNPKTKESKLKAAARIVPEWVEYDAEIRQLLDHLENKKQDTILTHDEL

SEQ ID NO: 13889 - protein, 278 aa, Homo Sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKS

SEQ ID NO: 13890 - protein, 280 aa, Homo Sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKLVY

SEQ ID NO: 13891 - protein, 372 aa, Homo Sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDSIKLMKDISQNFPIKARLRMNILICLFQSTLNVKNLRSRHLYNKT

SEQ ID NO: 13892 - protein, 280 aa, Homo Sapiens [sequence omitted]

SEQ ID NO: 13893 - protein, 278 aa, Homo Sapiens; identical to SEQ ID NO: 13889

SEQ ID NO: 13894 - protein, 530 aa, Homo Sapiens
MARAGWTSPVPLCVCLLLTCGFAEAGKLLVVPMDGSHWFTMQSVVEKLILRGHEVVVVMPEVSWQLERSLNCTVKTYSTSYTLEDQNREFMVFAHAQWKAQAQSIFSLLMSSSSGFLDLFFSHCRSLFNDRKLVEYLKESSFDAVFLDPFDTCGLIVAKYFSLPSVVFTRGIFCHHLEEGAQCPAPLSYVPNDLLGFSDAMTFKERVWNHIVHLEDHLFCQYLFRNALEIASEILQTPVTAYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 13895 - protein, 441 aa, Homo Sapiens
MARAGWTSPVPLCVCLLLTCGFAEAGKLLVVPMDGSHWFTMQSVVEKLILRGHEVVVVMPEVSWQLERSLNCTVKTYSTSYTLEDQNREFMVFAHAQWKAQAQSIFSLLMSSSSGFLDLFFSHCRSLFNDRKLVEYLKESSFDAVFLDPFDTCGLIVAKYFSLPSVVFTRGIFCHHLEEGAQCPAPLSYVPNDLLGFSDAMTFKERVWNHIVHLEDHLFCQYLFRNALEIASEILQTPVTAYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKRKKQQSGRQM

SEQ ID NO: 13896 - protein, 158 aa, Homo Sapiens
MLNNLLLFSLQISLIGTTLGGNVLIWPMEGSHWLNVKIIIDELIKKEHNVTVLVASGALFITPTSNPSLTFEIYKVPFGKERIEGVIKDFVLTWLENRPSPSTIWRFYQEMAKVIKDFHMVSQEICDGVLKNQQLMAKLKKSKFEVLVSDPVFPCGDI

SEQ ID NO: 13897 - protein, 693 aa, Homo Sapiens
MLNNLLLFSLQISLIGTTLGGNVLIWPMEGSHWLNVKIIIDELIKKEHNVTVLVASGALFITPTSNPSLTFEIYKVPFGKERIEGVIKDFVLTWLENRPSPSTIWRFYQEMAKVIKDFHMVSQEICDGVLKNQQLMAKLKKSKFEVLVSDPVFPCGDIVALKLGIPFMYSLRFSPASTVEKHCGKVPYPPSYVPAVLSELTDQMSFTDRIRNFISYHLQDYMFETLWKSWDSYYSKALDGSHWLNIKIILEELIQRNHNVTVLASSATLFINSNPDSPVNFEVIPVSYKKSNIDSLIEHMIMLWIDHRPTPLTIWAFYKELGKLLDTFFQINIQLCDGVLKNPKLMARLQKGGFDVLVADPVTICGDLVALKLGIPFMYTLRFSPASTVERHCGKIPAPVSYVPAALSELTDQMTFGERIKNTISYSLQDYIFQSYWGEWNSYYSKILGRPTTLCETMGKAEIWLIRTYWDFEFPRPYLPNFEFVGGLHCKPAKPLPKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 13898 - protein, 527 aa, Homo Sapiens
MLNNLLLFSLQISLIGTTLGGNVLIWPMEGSHWLNVKIIIDELIKKEHNVTVLVASGALFITPTSNPSLTFEIYKVPFGKERIEGVIKDFVLTWLENRPSPSTIWRFYQEMAKVIKDFHMVSQEICDGVLKNQQLMAKLKKSKFEVLVSDPVFPCGDIVALKLGIPFMYSLRFSPASTVEKHCGKVPYPPSYVPAVLSELTDQMSFTDRIRNFISYHLQDYMFETLWKSWDSYYSKALGGLLLCCPGWSAVADLGSLQPLLPGFKRFSRLSLHCSWDYRLPAGRPTTLCETMGKAEIWLIRTYWDFEFPRPYLPNFEFVGGLHCKPAKPLPKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 13899 - protein, 483 aa, Homo Sapiens
MLNNLLLFSLQISLIGTTLGGNVLIWPMEGSHWLNVKIIIDELIKKEHNVTVLVASGALFITPTSNPSLTFEIYKVPFGKERIEGVIKDFVLTWLENRPSPSTIWRFYQEMAKVIKDFHMVSQEICDGVLKNQQLMAKLKKSKFEVLVSDPVFPCGDIVALKLGIPFMYSLRFSPASTVEKHCGKVPYPPSYVPAVLSELTDQMSFTDRIRNFISYHLQDYMFETLWKSWDSYYSKALGRPTTLCETMGKAEIWLIRTYWDFEFPRPYLPNFEFVGGLHCKPAKPLPKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 13900 - protein, 527 aa, Homo Sapiens
MLNNLLLFSLQISLIGTTLGGNVLIWPMEGSHWLNVKIIIDELIKKEHNVTVLVASGALFITPTSNPSLTFEIYKVPFGKERIEGVIKDFVLTWLENRPSPSTIWRFYQEMAKVIKDFHMVSQEICDGVLKNQQLMAKLKKSKFEVLVSDPVFPCGDIVALKLGIPFMYSLRFSPASTVEKHCGKVPYPPSYVPAVLSELTDQMSFTDRIRNFISYHLQDYMFETLWKSWDSYYSKALGRPTTLCETMGKAEIWLIRTYWDFEFPRPYLPNFEFVGGLHCKPAKPLPKEMEEFIQSSGKNGVVVFSLGSMVKNLTEEKANLIASALAQIPQKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 13901 - protein, 529 aa, Homo Sapiens
MTLKWTSVLLLIHLSCYFSSGSCGKVLVWAAEYSHWMNMKTILKELVQRGHEVTVLASSASILFDPNDASTLKFEVYPTSLTKTEFENIIMQQVKRWSDIRKDSFWLYFSQEQEILWELYDIFRNFCKDVVSNKKVMKKLQESRFDIVFADAVFPCGELLAALLNIRFVYSLRFTPGYTIERHSGGLIFPPSYIPIVMSKLSDQMTFMERVKNMIYVLYFDFWFQMSDMKKWDQFYSEVLGRPTTLFETMGKADIWLMRNSWSFQFPHPFLPNVDFVGGFHCKPAKPLPKEMEEFVQSSGENGVVVFSLGSVISNMTAERANVIATALAKIPQKVLWRFDGNKPDALGLNTRLYKWIPQNDLLGHPKTRAFITHGGANGIYEAIYHGIPMVGIPLFFDQPDNIAHMKAKGAAVRLDFNTMSSTDLLNALKTVINDPLYKENIMKLSRIQHDQPVKPLDRAVFWIEFVMPHKGAKHLRVAAHDLTWFQYHSLDVIGFLLACVATVIFIITKFCLFCFWKFARKGKKGKRD

SEQ ID NO: 13902 - protein, 529 aa, Homo Sapiens
MALKWTSVLLLIHLGCYFSSGSCGKVLVWTGEYSHWMNMKTILKELVQRGHEVTVLASSASILFDPNDAFTLKLEVYPTSLTKTEFENIIMQQVKRWSDIQKDSFWLYFSQEQEILWEFHDIFRNFCKDVVSNKKVMKKLQESRFDIIFADAFFPCGELLAALLNIPFVYSLCFTPGYTIERHSGGLIFPPSYIPVVMSKLSDQMTFMERVKNMIYVLYFDFWFQMCDMKKWDQFYSEVLGRPTTLFETMGKADIWLMRNSWSFQFPHPFLPNIDFVGGLHCKPAKPLPKEMEEFVQSSGENGVVVFSLGSVISNMTAERANVIATALAKIPQKVLWRFDGNKPDALGLNTRLYKWIPQNDLLGLPKTRAFITHGGANGIYEAIYHGIPMVGIPLFWDQPDNIAHMKAKGAAVRLDFHTMSSTDLLNALKTVINDPSYKENVMKLSIIQHDQPVKPLHRAVFWIEFVMCHKGAKHLRVAARDLTWFQYHSLDVIGFLLACVATVIFVVTKFCLFCFWKFARKGKKGKRD

SEQ ID NO: 13903 - protein, 335 aa, Homo Sapiens
MALKWTSVLLLIHLGCYFSSGSCGKVLVWTGEYSHWMNMKTILKELVQRGHEVTVLASSASILFDPNDAFTLKLEVYPTSLTKTEFENIIMQQVKRWSDIQKDSFWLYFSQEQEILWEFHDIFRNFCKDVVSNKKVMKKLQESRFDIIFADAFFPCGELLAALLNIPFVYSLCFTPGYTIERHSGGLIFPPSYIPVVMSKLSDQMTFMERVKNMIYVLYFDFWFQMCDMKKWDQFYSEVLGRPTTLFETMGKADIWLMRNSWSFQFPHPFLPNIDFVGGLHCKPAKPLPKEMEEFVQSSGENGVVVFSLGSVISNMTAERANVIATALAKIPQKI

SEQ ID NO: 13904 - protein, 54 aa, Homo Sapiens
MSMKWTSALLLIQLSCYFSSGSCGKVLVWPTEFSHWMNIKTILDELVQRGHEVT

SEQ ID NO: 13905 - protein, 528 aa, Homo Sapiens
MSMKWTSALLLIQLSCYFSSGSCGKVLVWPTEFSHWMNIKTILDELVQRGHEVTVLASSASISFDPNSPSTLKFEVYPVSLTKTEFEDIIKQLVKRWAELPKDTFWSYFSQVQEIMWTFNDILRKFCKDIVSNKKLMKKLQESRFDVVLADAVFPFGELLAELLKIPFVYSLRFSPGYAIEKHSGGLLFPPSYVPVVMSELSDQMTFIERVKNMIYVLYFEFWFQIFDMKKWDQFYSEVLGRPTTLSETMAKADIWLIRNYWDFQFPHPLLPNVEFVGGLHCKPAKPLPKEMEEFVQSSGENGVVVFSLGSMVSNTSEERANVIASALAKIPQKVLWRFDGNKPDTLGLNTRLYKWIPQNDLLGHPKTRAFITHGGANGIYEAIYHGIPMVGVPLFADQPDNIAHMKAKGAAVSLDFHTMSSTDLLNALKTVINDPLYKENAMKLSRIHHDQPVKPLDRAVFWIEFVMRHKGAKHLRVAAHDLTWFQYHSLDVTGFLLACVATVIFIITKCLFCVWKFVRTGKKGKRD

SEQ ID NO: 13906 - protein, 369 aa, Homo Sapiens
MSMKWTSALLLIQLSCYFSSGSCGKVLVWPTEFSHWMNIKTILDELVQRGHEVTVLASSASISFDPNSPSTLKFEVYPVSLTKTEFEDIIKQLVKRWAELPKDTFWSYFSQVQEIMWTFNDILRKFCKDIVSNKKLMKKLQESRFDVVLADAVFPFGELLAELLKIPFVYSLRFSPGYAIEKHSGGLLFPPSYVPVVMSELSDQMTFIERVKNMIYVLYFEFWFQIFDMKKWDQFYSEVLGRPTTLSETMAKADIWLIRNYWDFQFPHPLLPNVEFVGGLHCKPAKPLPKEMEEFVQSSGENGVVVFSLGSMVSNTSEERANVIASALAKIPQKVLWRFDGNKPDTLGLNTRLYKWIPQNDLLDIKRML

SEQ ID NO: 13907 - protein, 369 aa, Homo Sapiens [sequence omitted]

SEQ ID NO: 13908 - protein, 156 aa, Homo Sapiens
MGKADVWLIRNSWNFQFPYPLLPNVDFVGGLHCKPAKPLPKEMEDFVQSSGENGVVVFSLGSMVSNMTEERANVIASALAQIPQKVLWRFDGNKPDTLGLNTRLYKWIPQNDLLGHPKTRAFITHGGANGIYEAIYHGIPMVGIPLFADQPDNIAH

SEQ ID NO: 13909 - protein, 529 aa, Homo Sapiens
MSVKWTSVILLIQLSFCFSSGNCGKVLVWAAEYSHWMNIKTILDELIQRGHEVTVLASSASILFDPNNSSALKIEIYPTSLTKTELENFIMQQIKRWSDLPKDTFWLYFSQVQEIMSIFGDITRKFCKDVVSNKKFMKKVQESRFDVIFADAIFPCSELLAELFNIPFVYSLSFSPGYTFEKHSGGFIFPPSYVPVVMSELTDQMTFMERVKNMIYVLYFDFWFEIFDMKKWDQFYSEVLGRPTTLSETMGKADVWLIRNSWNFQFPYPLLPNVDFVGGLHCKPAKPLPKEMEDFVQSSGENGVVVFSLGSMVSNMTEERANVIASALAQIPQKVLWRFDGNKPDTLGLNTRLYKWIPQNDLLGHPKTRAFITHGGANGIYEAIYHGIPMVGIPLFADQPDNIAHMKARGAAVRVDFNTMSSTDLLNALKRVINDPSYKENVMKLSRIQHDQPVKPLDRAVFWIEFVMRHKGAKHLRVAAHDLTWFQYHSLDVIGFLLVCVATVIFIVTKCCLFCFWKFARKAKKGKND

SEQ ID NO: 13910 - protein, 369 aa, Homo Sapiens
MSVKWTSVILLIQLSFCFSSGNCGKVLVWAAEYSHWMNIKTILDELIQRGHEVTVLASSASILFDPNNSSALKIEIYPTSLTKTELENFIMQQIKRWSDLPKDTFWLYFSQVQEIMSIFGDITRKFCKDVVSNKKFMKKVQESRFDVIFADAIFPCSELLAELFNIPFVYSLSFSPGYTFEKHSGGFIFPPSYVPVVMSELTDQMTFMERVKNMIYVLYFDFWFEIFDMKKWDQFYSEVLGRPTTLSETMGKADVWLIRNSWNFQFPYPLLPNVDFVGGLHCKPAKPLPKEMEDFVQSSGENGVVVFSLGSMVSNMTEERANVIASALAQIPQKVLWRFDGNKPDTLGLNTRLYKWIPQNDLLDIKRML

SEQ ID NO: 13911 - protein, 335 aa, Homo Sapiens
MSVKWTSVILLIQLSFCFSSGNCGKVLVWAAEYSHWMNIKTILDELIQRGHEVTVLASSASILFDPNNSSALKIEIYPTSLTKTELENFIMQQIKRWSDLPKDTFWLYFSQVQEIMSIFGDITRKFCKDVVSNKKFMKKVQESRFDVIFADAIFPCSELLAELFNIPFVYSLSFSPGYTFEKHSGGFIFPPSYVPVVMSELTDQMTFMERVKNMIYVLYFDFWFEIFDMKKWDQFYSEVLGRPTTLSETMGKADVWLIRNSWNFQFPYPLLPNVDFVGGLHCKPAKPLPKEMEDFVQSSGENGVVVFSLGSMVSNMTEERANVIASALAQIPQKI

SEQ ID NO: 13912 - protein, 252 aa, Homo Sapiens
MLHQSGKFLIPDIKEEEKSYQVIRWFSPEDHQKRIKKHFDSYIETALDGRKESEALVKLMEIFGTQCSYLLSRKDIMDSLKNENYDLVFVEAFDFCSFLIAEKLVKPFVAILPTTFGSLDFGLPSPLSYVPVFPSLLTDHMDFWGRVKNFLMFFSFSRSQWDMQSTFDNTIKEHFPEGSRPVLSHLLLKAELWFVNSDFAFDFARPLLPNTVYIGGLMEKPIKPVPQNGQPALFTTPSLFSSGVYPEPLRWL

SEQ ID NO: 13913 - protein, 252 aa, Homo Sapiens; identical to SEQ ID NO: 13912

SEQ ID NO: 13914 - protein, 402 aa, Homo Sapiens
MVGQRVLLLVAFLLSGVLLSEAAKILTISTLDIKEEEKSYQVIRWFSPEDHQKRIKKHFDSYIETALDGRKESEALVKLMEIFGTQCSYLLSRKDIMDSLKNENYDLVFVEAFDFCSFLIAEKLVKPFVAILPTTFGSLDFGLPSPLSYVPVFPSLLTDHMDFWGRVKNFLMFFSFSRSQWDMQSTFDNTIKEHFPEGSRPVLSHLLLKAELWFVNSDFAFDFARPLLPNTVYIGGLMEKPIKPVPQDLDNFIANFGDAGFVLVAFGSMLNTHQSQEVLKKMHNAFAHLPQGVIWTCQSSHWPRDVHLATNVKIVDWLPQSDLLAHPSIRLFVTHGGQNSVMEAIRHGVPMVGLPVNGDQHGNMVRVVAKNYGVSIRLNQVTADTLTLTMKQVIEDKRYVAL

SEQ ID NO: 13915 - protein, 57 aa, Homo Sapiens
MVGQRVLLLVAFLLSGVLLSEAAKILTISTLGECLAGEFPDRRVPDPRTARAPANGD

SEQ ID NO: 13916 - protein, 523 aa, Homo Sapiens
MVGQRVLLLVAFLLSGVLLSEAAKILTISTLGGSHYLLLDRVSQILQEHGHNVTMLHQSGKFLIPDIKEEEKSYQVIRWFSPEDHQKRIKKHFDSYIETALDGRKESEALVKLMEIFGTQCSYLLSRKDIMDSLKNENYDLVFVEAFDFCSFLIAEKLVKPFVAILPTTFGSLDFGLPSPLSYVPVFPSLLTDHMDFWGRVKNFLMFFSFSRSQWDMQSTFDNTIKEHFPEGSRPVLSHLLLKAELWFVNSDFAFDFARPLLPNTVYIGGLMEKPIKPVPQDLDNFIANFGDAGFVLVAFGSMLNTHQSQEVLKKMHNAFAHLPQGVIWTCQSSHWPRDVHLATNVKIVDWLPQSDLLAHPSIRLFVTHGGQNSVMEAIRHGVPMVGLPVNGDQHGNMVRVVAKNYGVSIRLNQVTADTLTLTMKQVIEDKRYKSAVVAASVILHSQPLSPAQRLVGWIDHILQTGGATHLKPYAFQQPWHEQYLIDVFVFLLGLTLGTMWLCGKLLGVVARWLRGARKVKKT

SEQ ID NO: 13917 - protein, 436 aa, Homo Sapiens
MVGQRVLLLVAFLLSGVLLSEAAKILTISTLGGSHYLLLDRVSQILQEHGHNVTMLHQSGKFLIPDIKEEEKSYQVIRWFSPEDHQKRIKKHFDSYIETALDGRKESEALVKLMEIFGTQCSYLLSRKDIMDSLKNENYDLVFVEAFDFCSFLIAEKLVKPFVAILPTTFGSLDFGLPSPLSYVPVFPSLLTDHMDFWGRVKNFLMFFSFSRSQWDMQSTFDNTIKEHFPEGSRPVLSHLLLKAELWFVNSDFAFDFARPLLPNTVYIGGLMEKPIKPVPQDLDNFIANFGDAGFVLVAFGSMLNTHQSQEVLKKMHNAFAHLPQGVIWTCQSSHWPRDVHLATNVKIVDWLPQSDLLAHPSIRLFVTHGGQNSVMEAIRHGVPMVGLPVNGDQHGNMVRVVAKNYGVSIRLNQVTADTLTLTMKQVIEDKRYVAL

SEQ ID NO: 13918 - protein, 489 aa, Homo Sapiens
MAGQRVLLLVGFLLPGVLLSEAAKILTISTVDFKKEEKSYQVISWLAPEDHQREFKKSFDFFLEETLGGRGKFENLLNVLEYLALQCSHFLNRKDIMDSLKNENFDMVIVETFDYCPFLIAEKLGKPFVAILSTSFGSLEFGLPIPLSYVPVFRSLLTDHMDFWGRVKNFLMFFSFCRRQQHMQSTFDNTIKEHFTEGSRPVLSHLLLKAELWFINSDFAFDFARPLLPNTVYVGGLMEKPIKPVPQDLENFIAKFGDSGFVLVTLGSMVNTCQNPEIFKEMNNAFAHLPQGVIWKCQCSHWPKDVHLAANVKIVDWLPQSDLLAHPSIRLFVTHGGQNSIMEAIQHGVPMVGIPLFGDQPENMVRVEAKKFGVSIQLKKLKAETLALKMKQIMEDKRYKSAAVAASVILRSHPLSPTQRLVGWIDHVLQTGGATHLKPYVFQQPWHEQYLLDVFVFLLGLTLGTLWLCGKLLGMAVWWLRGARKVKET

SEQ ID NO: 13919 - protein, 138 aa, Homo Sapiens
MAGQRVLLLVGFLLPGVLLSEAAKILTISTVGGSHYLLMDRVSQILQDHGHNVTMLNHKRGPFMPDFKKEEKSYQVISWLAPEDHQREFKKSFDFFLEETLGGRGKFENLLNVLEYLALQCSHFLNRKDIMDSLKNEN

SEQ ID NO: 13920 - protein, 523 aa, Homo Sapiens
MAGQRVLLLVGFLLPGVLLSEAAKILTISTVGGSHYLLMDRVSQILQDHGHNVTMLNHKRGPFMPDFKKEEKSYQVISWLAPEDHQREFKKSFDFFLEETLGGRGKFENLLNVLEYLALQCSHFLNRKDIMDSLKNENFDMVIVETFDYCPFLIAEKLGKPFVAILSTSFGSLEFGLPIPLSYVPVFRSLLTDHMDFWGRVKNFLMFFSFCRRQQHMQSTFDNTIKEHFTEGSRPVLSHLLLKAELWFINSDFAFDFARPLLPNTVYVGGLMEKPIKPVPQDLENFIAKFGDSGFVLVTLGSMVNTCQNPEIFKEMNNAFAHLPQGVIWKCQCSHWPKDVHLAANVKIVDWLPQSDLLAHPSIRLFVTHGGQNSIMEAIQHGVPMVGIPLFGDQPENMVRVEAKKFGVSIQLKKLKAETLALKMKQIMEDKRYKSAAVAASVILRSHPLSPTQRLVGWIDHVLQTGGATHLKPYVFQQPWHEQYLLDVFVFLLGLTLGTLWLCGKLLGMAVWWLRGARKVKET

SEQ ID NO: 13921 - protein, 120 aa, Homo Sapiens
MAGQRVLLLVGFLLPGVLLSEAAKILTISTVGGSHYLLMDRVSQILQDHGHNVTMLNHKRGPFMPDFKKEEKSYQVISWLAPEDHQREFKKSFDFFLEETLGGRTWRTSLPSLGTLVLSL

SEQ ID NO: 13922 - protein, 141 aa, Homo Sapiens
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLTAIELFDILDHYTKNCDLMVGNHALIQGLKKEKFDLLLVDPND

SEQ ID NO: 13923 - protein, 541 aa, Homo Sapiens
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLTAIELFDILDHYTKNCDLMVGNHALIQGLKKEKFDLLLVDPNDMCGFVIAHLLGVKYAVFSTGLWYPAEVGAPAPLAYVPEFNSLLTDRMNLLQRMKNTGVYLISRLGVSFLVLPKYERIMQKYNLLPEKSMYDLVHGSSLWMLCTDVALEFPRPTLPNVVYVGGILTKPASPLPEDLQRWVNGANEHGFVLVSFGAGVKYLSEDIANKLAGALGRLPQKVIWRFSGPKPKNLGNNTKLIEWLPQNDLLGHSKIKAFLSHGGLNSIFETIYHGVPVVGIPLFGDHYDTMTRVQAKGMGILLEWKTVTEKELYEALVKVINNPSYRQRAQKLSEIHKDQPGHPVNRTIYWIDYIIRHNGAHHLRAAVHQISFCQYFLLDIAFVLLLGAALLYFLLSWVTKFIYRKIKSLWSRNKHSTVNGHYHNGILNGKYKRNGHIKHEKKVK

SEQ ID NO: 13924 - protein, 541 aa, Homo Sapiens; identical to SEQ ID NO: 13923

SEQ ID NO: 13925 - protein, 244 aa, Homo Sapiens
MAAAASPAILPRLAILPYLLFDWSGTGRADAHSLWYNFTIIHLPRHGQQWCEVQSQVDQKNFLSYDCGSDKVLSMGHLEEQLYATDAWGKQLEMLREVGQRLRLELADTELEDFTPSGPLTLQVRMSCECEADGYIRGSWQFSFDGRKFLLFDSNNRKWTVVHAGARRMKEKWEKDSGLTTFFKMVSMRDCKSWLRDFLMHRKKRLEPTAPPTMAPGLAQPKAIATTLSPWSFLIILCFILPGI

SEQ ID NO: 13926 - protein, 244 aa, Homo Sapiens; identical to SEQ ID NO: 13925

SEQ ID NO: 13927 - protein, 29 aa, Homo Sapiens
MGQPSLTWMLMVVVASWFITTAATDTSEA

SEQ ID NO: 13928 - protein, 673 aa, Homo Sapiens
MGQPSLTWMLMVVVASWFITTAATDTSEARTKYNCPARWSWRTPQRGGDTEQGPDEDFTSQGRWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCPAGYRGDGWHCECSPGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHCQCKQDFNITDISLLEHRLECGANDMKVSLGKCQLKSLGFDKVFMYLSDSRCSGFNDRDNRDWVSVVTPARDGPCGTVLTRNETHATYSNTLYLADEIIIRDLNIKINFACSYPLDMKVSLKTALQPMVSALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLHCEVYLCDTMNEKCKPTCSGTRFRSGSVIDQSRVLNLGPITRKGVQATVSRAFSSLGLLKVWLPLLLSATLTLTFQ

SEQ ID NO: 13929 - protein, 161 aa, Homo Sapiens
MGQPSLTWMLMVVVASWFITTAATDTSEARTKYNCPARWSWRTPQRGGDTEQGPDEDFTSQGSRKHKMCKEREGQQVHRKSYQRWCSECHSNATCTEDEAVTTCTCQEGFTGDGLTCVDLDECAIPGAHNCSANSSCVNTPGSFSCVCPEGFRLSPGLGCT

SEQ ID NO: 13930 - protein, 161 aa, Homo Sapiens
MGQPSLTWMLMVVVASWFITTAATDTSEARTKYNCPARWSWRTPQRGGDTEQGWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCP

SEQ ID NO: 13931 - protein, 86 aa, Homo Sapiens
MGQPSLTWMLMVVVASWFITTAATDTSEARWCSECHSNATCTEDEAVTTCTCQEGFTGDGLTCVDLDECAIPGAHNCSANSSCVNT

SEQ ID NO: 13932 - protein, 88 aa, Homo Sapiens
MGQPSLTWMLMVVVASWFITTAATDTSEARWCSECHSNATCTEDEAVTTCTCQEGFTGDGLTCVDLDECAIPGAHNCSANSSCVNTPG

SEQ ID NO: 13933 - protein, 103 aa, Homo Sapiens
MGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPG

SEQ ID NO: 13934 - protein, 125 aa, Homo Sapiens
MGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVDECAEPGLSHCHALAT

SEQ ID NO: 13935 - protein, 640 aa, Homo Sapiens
MGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCPAGYRGDGWHCECSPGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHCQCKQDFNITDISLLEHRLECGANDMKVSLGKCQLKSLGFDKVFMYLSDSRCSGFNDRDNRDWVSVVTPARDGPCGTVLTRNETHATYSNTLYLADEIIIRDLNIKINFACSYPLDMKVSLKTALQPMVSALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLHCEVYLCDTMNEKCKPTCSGTRFRSGSVIDQSRVLNLGPITRKGVQATVSRAFSSLGLLKVWLPLLLSATLTLTFQ

SEQ ID NO: 13936 - protein, 640 aa, Homo Sapiens; identical to SEQ ID NO: 13935

SEQ ID NO: 13937 - protein, 689 aa, Homo Sapiens
MRHIMTRLTLPFWLQDTRHQRQREKFKGPTRLSFGQVLSRPEVAGRAERMGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCPAGYRGDGWHCECSPGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHCQCKQDFNITDISLLEHRLECGANDMKVSLGKCQLKSLGFDKVFMYLSDSRCSGFNDRDNRDWVSVVTPARDGPCGTVLTRNETHATYSNTLYLADEIIIRDLNIKINFACSYPLDMKVSLKTALQPMVSALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLHCEVYLCDTMNEKCKPTCSGTRFRSGSVIDQSRVLNLGPITRKGVQATVSRAFSSLGLLKVWLPLLLSATLTLTFQ

SEQ ID NO: 13938 - protein, 138 aa, Homo Sapiens
MRHIMTRLTLPFWLQVLSRPEVAGRAERMGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVD

SEQ ID NO: 13939 - protein, 890 aa, Homo Sapiens
DDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQTAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMRPPMDDSQTLLTPVVSCGPPGALLTRPVVLTMHHCADPNTEDWKILLKNQAAQGQWEDVVVVGEENFTTPCYIQLDAEACHILTENLSTYALVGHSTTKAAAKRLKLAIFGPLCCSSLEYSIRVYCLDDTQDALKEILHLERQMGGQLLEEPKALHFKGSTHNLRLSIHDIAHSLWKSKLLAKYQEIPFYHVWSGSQRNLHCTFTLERFSLNTVELVCKLCVRQVEGEGQIFQLNCTVSEEPTGIDLPLLDPANTITTVTGPSAFSIPLPIRQKLCSSLDAPQTRGHDWRMLAHKLNLDRYLNYFATKSSPTGVILDLWEAQNFPDGNLSMLAAVLEEMGRHETVVSLAAEGQY

SEQ ID NO: 13940 - protein, 931 aa, Homo Sapiens
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQTAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMRPPMDDSQTLLTPVVSCGPPGALLTRPVVLTMHHCADPNTEDWKILLKNQAAQGQWEDVVVVGEENFTTPCYIQLDAEACHILTENLSTYALVGHSTTKAAAKRLKLAIFGPLCCSSLEYSIRVYCLDDTQDALKEILHLERQMGGQLLEEPKALHFKGSTHNLRLSIHDIAHSLWKSKLLAKYQEIPFYHVWSGSQRNLHCTFTLERFSLNTVELVCKLCVRQVEGEGQIFQLNCTVSEEPTGIDLPLLDPANTITTVTGPSAFSIPLPIRQKLCSSLDAPQTRGHDWRMLAHKLNLDRYLNYFATKSSPTGVILDLWEAQNFPDGNLSMLAAVLEEMGRHETVVSLAAEGQY

SEQ ID NO: 13941 - protein, 260 aa, Homo Sapiens
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYGP

SEQ ID NO: 13942 - protein, 597 aa, Homo Sapiens
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQSFIYPISTEQRTQNEYGFSSAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMR

SEQ ID NO: 13943 - protein, 745 aa, Homo Sapiens
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQSFIYPISTEQRTQNEYGFSSAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMRPPMDDSQTLLTPVVSCGPPGALLTRPVVLTMHHCADPNTEDWKILLKNQAAQGQWEDVVVVGEENFTTPCYIQLDAEACHILTENLSTYALVGHSTTKAAAKRLKLAIFGPLCCSSLEYSIRVYCLDDTQDALKEILHLERQMGGQLL

SEQ ID NO: 13944 - protein, 265 aa, Homo Sapiens
MGLPWGQPHLGLQMLLLALNCLRPSLSLELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPRIHRHLARAAKWQHDRHYLHPLFSGRPPTLGLLGSLYHALLQPVVAGGGPGAAADRLLHGQALHDPPHPTQRGRHTAGGLQAWPGPPPQPQPLAWPLCMGLGEMGRWE

SEQ ID NO: 13945 - protein, 276 aa, Homo Sapiens
MGLPWGQPHLGLQMLLLALNCLRPSLSLELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYRVKFLLMDTRGSPRAETKWSDPITLHQGKTPGSIDTWPGRRSGSMIVITSILSSLAGLLLLAFLAASTMRFSSLWWPEEAPEQLRIGSFMGKRYMTHHIPPREAATLPVGCKPGLDPLPSLSP

SEQ ID NO: 13946 - protein, 320 aa, Homo Sapiens
MGLPWGQPHLGLQMLLLALNCLRPSLSLGEWGSWMDASSQTQGAGGPAGVIGPWAPAPLRLGEAAPGTPTPVSVAHLLSPVATELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPRIHRHLARAAKWQHDRHYLHPLFSGRPPTLGLLGSLYHALLQPVVAGGGPGAAADRLLHGQALHDPPHPTQRGRHTAGGLQAWPGPPPQPQPLAWPLCMGLGEMGRWE

SEQ ID NO: 13947 - protein, 920 aa, Homo Sapiens
MATVAANPAAAAAAVAAAAAVTEDREPQHEELPGLDSQWRQIENGESGRERPLRAGESWFLVEKHWYKQWEAYVQGGDQDSSTFPGCINNATLFQDEINWRLKEGLVEGEDYVLLPAAAWHYLVSWYGLEHGQPPIERKVIELPNIQKVEVYPVELLLVRHNDLGKSHTVQFSHTDSIGLVLRTARERFLVEPQEDTRLWAKNSEGSLDRLYDTHITVLDAALETGQLIIMETRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 13948 - protein, 963 aa, Homo Sapiens
MAVAPRLFGGLCFRFRDQNPEVAVEGRLPISHSCVGCRRERTAMATVAANPAAAAAAVAAAAAVTEDREPQHEELPGLDSQWRQIENGESGRERPLRAGESWFLVEKHWYKQWEAYVQGGDQDSSTFPGCINNATLFQDEINWRLKEGLVEGEDYVLLPAAAWHYLVSWYGLEHGQPPIERKVIELPNIQKVEVYPVELLLVRHNDLGKSHTVQFSHTDSIGLVLRTARERFLVEPQEDTRLWAKNSEGSLDRLYDTHITVLDAALETGQLIIMETRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 13949 - protein, 49 aa, Homo Sapiens
METRKKDGTWPSAQLHVMNNNMSEEDEDFKGQPGICGLTNLGNTCFMNS

SEQ ID NO: 13950 - protein, 140 aa, Homo Sapiens
METRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLH

SEQ ID NO: 13951 - protein, 494 aa, Homo Sapiens
MPLYSVTVKWGKEKFEGVELNTDEPPMVFKAQLFALTGVQPARQKVMVKGGTLKDDDWGNIKIKNGMTLLMMGSADALPEEPSAKTVFVEDMTEEQLASAMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 13952 - protein, 459 aa, Homo Sapiens
MPLYSVTVKWGKEKFEGVELNTDEPPMVFKAQLFALTGVQPARQKVMVKGGTLKDDDWGNIKIKNMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 13953 - protein, 483 aa, Homo Sapiens
MPLYSVTVKWGKEKFEGVELNTDEPPMVFKAQLFALTGVQPARQKVMVKGGTLKGMTLLMMGSADALPEEPSAKTVFVEDMTEEQLASAMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 13954 - protein, 448 aa, Homo Sapiens
MPLYSVTVKWGKEKFEGVELNTDEPPMVFKAQLFALTGVQPARQKVMVKGGTLKMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 13955 - protein, 20 aa, Homo Sapiens
MVFKAQLFALTGVQPARQKV

SEQ ID NO: 13956 - protein, 28 aa, Homo Sapiens
MVFKAQLFALTGVQPARQKVMVKGGTLK

SEQ ID NO: 13957 - protein, 33 aa, Homo Sapiens
  misc_feature (1)..(1): Xaa can be any naturally occurring amino acid
XALTGVQPARQKVMVKGGTLKDFHEITFFKNRE

SEQ ID NO: 13958 - protein, 106 aa, Homo Sapiens
HWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 13959 - protein, 56 aa, Homo Sapiens
MECPHLSSSVCIAPDSAKFPNGSPSSWCCSAFKCLSGVTVLCPQRVLYVAQAGLEL

SEQ ID NO: 13960 - protein, 56 aa, Homo Sapiens; identical to SEQ ID NO: 13959

SEQ ID NO: 13961 - protein, 132 aa, Homo Sapiens
MECPHLSSSVCIAPDSAKFPNGSPSSWCCSEMEFHHFTKAGLELLDSSNLPASASQSVGTTVCRSNKSPWVCLTCSSVHCGRYVNGHAKKHYEDAQVPLTNHKKSEKQDKVQHTVCMDCSSYSTYCYRCDDF

SEQ ID NO: 13962 - protein, 79 aa, Homo Sapiens
MECPHLSSSVCIAPDSAKFPNGSPSSWCCSGAINSRTPMNSCATFWTTYTWNFRAVSTVFPAQQFCRRILLCLQVTSVA

SEQ ID NO: 13963 - protein, 55 aa, Homo Sapiens
MECPHLSSSVCIAPDSAKFPNGSPSSWCCSVCRSNKSPWVCLTCSSVHCGRIWGT

SEQ ID NO: 13964 - protein, 520 aa, Homo Sapiens
MECPHLSSSVCIAPDSAKFPNGSPSSWCCSVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 13965 - protein, 133 aa, Homo Sapiens
MECPHLSSSVCIAPDSAKFPNGSPSSWCCSVCRSNKSPWVCLTCSSVHCGSYRCDDFVVNDTKLGLVQKVREHLQNLENSAFTADRHKKRKLLENSTLNSKLLKVNGSTTAICATGLRNLGNTCFMNAILQSL

SEQ ID NO: 13966 - protein, 476 aa, Homo Sapiens
MECPHLSSSVCIAPDSAKFPNGSPSSWCCSVCRSNKSPWVCLTCSSVHCGSYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 13967 - protein, 431 aa, Homo Sapiens
MENTEGYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 13968 - protein, 503 aa, Homo Sapiens
MMQLVYCVFFFLLVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 13969 - protein, 39 aa, Homo Sapiens
MQSPPHLAVCRSNKSPWVCLTCSSVHCGRYVNGHAKKHY

SEQ ID NO: 13970 - protein, 126 aa, Homo Sapiens
MQSPPHLAVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLK

SEQ ID NO: 13971 - protein, 498 aa, Homo Sapiens
MQSPPHLAVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 13972 - protein, 443 aa, Homo Sapiens
  misc_feature (1)..(1): Xaa can be any naturally occurring amino acid
XKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 13973 - protein, 6 aa, Homo Sapiens
  misc_feature (1)..(1): Xaa can be any naturally occurring amino acid
XSYSTY

SEQ ID NO: 13974 - protein, 211 aa, Homo Sapiens
KNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQPLLFMDLLDERTLVAVERPLDDIIAQLPPPIKKKKFGT

SEQ ID NO: 13975 - protein, 182 aa, Homo Sapiens
MASVDLSYCSFLHLLLLCSPILACPPLNGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVF

SEQ ID NO: 13976 - protein, 79 aa, Homo Sapiens
MEYDLQALNIKYAMDAFGGPIWSMAASPSGSQLLVGCEDGSVKLFQITPDKIQFERNFDRQKSRILSLSWHPSGTHIAA

SEQ ID NO: 13977 - protein, 143 aa, Homo Sapiens
MEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATG

SEQ ID NO: 13978 - protein, 148 aa, Homo Sapiens
MGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRI

SEQ ID NO: 13979 - protein, 571 aa, Homo Sapiens
MGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 13980 - protein, 686 aa, Homo Sapiens
MGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 13981 - protein, 625 aa, Homo Sapiens
MGEFKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLVSSSLLPPKSSSES

SEQ ID NO: 13982 - protein, 198 aa, Homo Sapiens
MVFLQFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVAD

SEQ ID NO: 13983 - protein, 700 aa, Homo Sapiens
RSTSGAEPESARARGAGAERGEHREGERGAAGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGSVKLFQITPDKIQFERNFDRQKSRILSLSWHPSGTHIAAGSIDYISVFDVKSGSAVHKMIVDRQYMGVSKRKCIVWGVAFLSDGTIISVDSAGKVQFWDSATGTLVKSHLIANADVQSIAVADQEDSFVVGTAEGTVFHFQLVPVTSNSSEKQWVRTKPFQHHTHDVRTVAHSPTALISGGTDTHLVFRPLMEKVEVKNYDAALRKITFPHRCLISCSKKRQLLLFQFAHHLELWRLGSTVATGKNGDTLPLSKNADHLLHLKTKGPENIICSCISPCGSWIAYSTVSRFFLYRLNYEHDNISLKRVSKMPAFLRSALQILFSEDSTKLFVASNQGALHIVQLSGGSFKHLHAFQPQSGTVEAMCLLAVSPDGNWLAASGTSAGVHVYNVKQLKLHCTVPAYNFPVTAMAIAPNTNNLVIAHSDQQVFEYSIPDKQYTDWSRTVQKQGFHHLWLQRDTPITHISFHPKRPMHILLHDAYMFCIIDKSLPLPNDKTLLYNPFPPTNESDVIRRRTAHAFKISKIYKPLLFMDLLDERTLVAVERPLDDIIAQLPPPIKKKKFGT

SEQ ID NO: 13984 - protein, 139 aa, Homo Sapiens
METNVFHLMLCVTSARTHKSTSLCFGHFNSYPSLPLIHDLLLEISFQLSAPHEDARLTPEELERASLLQILPEMLGAERGDILRKADSSTNIFNPRGNLRKFQDFSGQDPNILLSHLLARIWKPYKKRETPDCFWKYCV

SEQ ID NO: 13985 - protein, 139 aa, Homo Sapiens
MYKLASCCLLFIGFLNPLLSLPLLDSREISFQLSAPHEDARLTPEELERASLLQILPEMLGAERGDILRKADSSTNIFNPRGNLRKFQDFSGQDPNILLSHLLARIWKPYKKQRRKLRQDLRLWKKEPGLRIFKNYVWV

SEQ ID NO: 13986 - protein, 124 aa, Homo Sapiens
MYKLASCCLLFIGFLNPLLSLPLLDSREISFQLSAPHEDARLTPEELERASLLQILPEMLGAERGDILRKADSSTNIFNPRGNLRKFQDFSGQDPNILLSHLLARIWKPYKKRETPDCFWKYCV

SEQ ID NO: 13987 - protein, 38 aa, Homo Sapiens
MNKILSSTVCFGLLTLLSVLSFLQSVHGRPYLTQGNEI

SEQ ID NO: 13988 - protein, 81 aa, Homo Sapiens
MNKILSSTVCFGLLTLLSVLSFLQSVHGRPYLTQGNEIFPDKKYTNREELLLALLNKNFDFQRPFNTAGKAKRTASGGEGF

SEQ ID NO: 13989 - protein, 81 aa, Homo Sapiens; identical to SEQ ID NO: 13988

SEQ ID NO: 13990 - protein, 119 aa, Homo Sapiens
MNKILSSTVCFGLLTLLSVLSFLQSVHGRPYLTQGNEIFPDKKYTNREELLLALLNKNFDFQRPFNTDLALPNKLEELNQLEKLKEQLVEEKDSETSYAVDGLFSSHPSKRACFWKYCV

SEQ ID NO: 13991 - protein, 119 aa, Homo Sapiens; identical to SEQ ID NO: 13990

SEQ ID NO: 13992 - protein, 132 aa, Homo Sapiens
MNKILSSTVCFGLLTLLSVLSFLQSVHGRPYLTQGNEIFPDKKYTNREELLLALLNKNFDFQRPFNTDLALPNKLEELNQLEKLKEQLVEEKDSETSYAVDGLFSSHPSKRALSSRTLIQLNCLQHCQNRRG

SEQ ID NO: 13993 - protein, 1240 aa, Homo Sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIK

SEQ ID NO: 13994 - protein, 1079 aa, Homo Sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLRAGMQWCDLSSLQPPPPGFKRFSHLSLPNSWNYRHLPSCPTNFCIFVETGFHHVGQACLELLTSGGLLASASQSAGITGVSHHAR

SEQ ID NO: 13995 - protein, 1347 aa, Homo Sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 13996 - protein, 1392 aa, Homo Sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 13997 - protein, 1389 aa, Homo Sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGSVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQQSLSLHMITSSQVEGLSSPAKKKRTSSPTKNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 13998 - protein, 1335 aa, Homo Sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEALSLSSSS

SEQ ID NO: 13999 - protein, 1444 aa, Homo Sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQAYRAHDPNTEHVLNHSQTPILQQSLSLHMITSSQVEGLSSPAKKKRTSSPTKNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 14000 - protein, 1363 aa, Homo Sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQAYLGHLTGFIQDNCNKGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 14001 - protein, 1211 aa, Homo Sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQNGSDNWNGGQSLSHHPVQQVYSLCLTPQKLQHLEQLRANRDNLNPAQKHQLEQLESQFVLMQQMRHKEVAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEALSLSSSS

SEQ ID NO: 14002 - protein, 1399 aa, Homo Sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAYRAHDPNTEHVLNHSQTPILQQSLSLHMITSSQVEGLSSPAKKKRTSSPTKNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 14003 - protein, 1367 aa, Homo Sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSEKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 14004 - protein, 207 aa, Homo Sapiens
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAESKYF

SEQ ID NO: 14005 - protein, 1264 aa, Homo Sapiens
MKSCAVSLTTAAVAFGDEAKKMAEGKASRESEEESVSLTVEEREALGGMDSRLFGFVRLHEDGARTKTLLGKNAAFLYGLGLVYFYYNAFHWAIKAFQDVLYVDPSFCRAKEIHLRLGLMFKVNTDYKSSLKRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 14006 - protein, 190 aa, Homo Sapiens
MVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMK

SEQ ID NO: 14007 - protein, 420 aa, Homo Sapiens
MVSKALLRLVSAVNRRRMKLLLGIALLAYVASVWGNFVNMRSIQENGELKIESKIEEMVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 14008 - protein, 425 aa, Homo Sapiens
MVSKALLRLVSAVNRRRMKLLLGIALLAYVASVWGNFVNMSFLLNRSIQENGELKIESKIEEMVEPLREKIRDLEKSFTQKYPPVKFLSEKDRKRILITGGAGFVGSHLTDKLMMDGHEVTVVDNFFTGRKRNVEHWIGHENFELINHDVVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 14009 - protein, 171 aa, Homo Sapiens [sequence omitted]

SEQ ID NO: 14010 - protein, 52 aa, Homo Sapiens
MYNPIKTLKTNTIGTLNMLGLAKRVGARLLLASTSEVYGDPEVHPQSEDYWG

SEQ ID NO: 14011 - protein, 121 aa, Homo Sapiens
MYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTV

SEQ ID NO: 14012 - protein, 134 aa, Homo Sapiens
MYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYV

SEQ ID NO: 14013 - protein, 252 aa, Homo Sapiens
MYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 14014 - protein, 91 aa, Homo Sapiens
MGPGEGNCWFCWCLCPWLLSGSWVHLISGKSPSLTRPVMGGGGGVEMFLQFCLPWQNLDPGKGKQGRSPSEKGLCSPLTRSLAQATSAPRA

SEQ ID NO: 14015 - protein, 365 aa, Homo Sapiens
MPGGKKVAGGGSSGATPTSAAATAPSGVRRLETSEGTSAQRDEEPEEEGEEDLRDGGVPFFVNRGGLPVDEATWERMWKHVAKIHPDGEKVAQRIRGATDLPKIPIPSVPTFQPSTPVPERLEAVQRYIRELQYNHTGTQFFEIKKSRPLTGLMDLAKEMTKEALPIKCLEAVILGIYLTNSMPTLERFPISFKTYFSGNYFRHIVLGVNFAGRYGALGMSRREDLMYKPPAFRTLSELVLDFEAAYGRCWHVLKKVKLGQSVSHDPHSVEQIEWKHSVLDVERLGRDDFRKELERHARDMRLKIGKGTGPPSPTKDRKKDVSSPQRAQSSPHRRNSRSERRPSGDKKTSEPKAMPDLNGYQIRV

SEQ ID NO: 14016 - protein, 204 aa, Homo Sapiens
MPGGKKVAGGGSSGATPTSAAATAPSGVRRLETSEGTSAQRDEEPEEEGEEDLRDGGVPFFVNRGGLPVDEATWERMWKHVAKIHPDGEKVAQRIRGATDLPKIPIPSVPTFQPSTPVPERLEAVQRYIRELQYNHTGTQFFEIKKSRPLTGLMDLAKEMTKEALPIKCLEAVILGMYPSSPEGEGSGLLWASASCSESEGGVG

SEQ ID NO: 14017 - protein, 3396 aa, Homo Sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 14018 - protein, 2409 aa, Homo Sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 14019 - protein, 1642 aa, Homo Sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 14020 - protein, 1240 aa, Homo Sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPI

SEQ ID NO: 14021 - protein, 655 aa, Homo Sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 14022 - protein, 354 aa, Homo Sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRKCLIPF

SEQ ID NO: 14023 - protein, 1594 aa, Homo Sapiens
MPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 14024 - protein, 111 aa, Homo Sapiens
APMAEGGGQNHHEVVKFMDVYQRSYCHPIETLVDIFQEYPDEIEYIFKPSCVPLMRCGGCCNDEGLECVPTEESNITMQTCKCSCKNTDSRCKARQLELNERTCRCDKPRR

SEQ ID NO: 14025 - protein, 317 aa, Homo Sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRCDKPRR

SEQ ID NO: 14026 - protein, 327 aa, Homo Sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 14027 - protein, 412 aa, Homo Sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 14028 - protein, 389 aa, Homo Sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRPCGPCSERRKHLFVQDPQTCKCSCKNTDSRCKARQLELNERTCRCDKPRR

SEQ ID NO: 14029 - protein, 354 aa, Homo Sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKM

SEQ ID NO: 14030 - protein, 371 aa, Homo Sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 14031 - protein, 395 aa, Homo Sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 14032 - protein, 371 aa, Homo Sapiens
LTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 14033 - protein, 371 aa, Homo Sapiens; identical to SEQ ID NO: 14030

SEQ ID NO: 14034 - protein, 327 aa, Homo Sapiens; identical to SEQ ID NO: 14026

SEQ ID NO: 14035 - protein, 389 aa, Homo Sapiens; identical to SEQ ID NO: 14028

SEQ ID NO: 14036 - protein, 371 aa, Homo Sapiens; identical to SEQ ID NO: 14032

SEQ ID NO: 14037 - protein, 354 aa, Homo Sapiens; identical to SEQ ID NO: 14029

SEQ ID NO: 14038 - protein, 395 aa, Homo Sapiens; identical to SEQ ID NO: 14031

SEQ ID NO: 14039 - protein, 412 aa, Homo Sapiens; identical to SEQ ID NO: 14027

SEQ ID NO: 14040 - protein, 163 aa, Homo Sapiens
MAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 14041 - protein, 137 aa, Homo Sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRCDKPRR

SEQ ID NO: 14042 - protein, 147 aa, Homo Sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 14043 - protein, 209 aa, Homo Sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRPCGPCSERRKHLFVQDPQTCKCSCKNTDSRCKARQLELNERTCRCDKPRR

SEQ ID NO: 14044 - protein, 215 aa, Homo Sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 14045 - protein, 232 aa, Homo Sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 14046 - protein, 191 aa, Homo Sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 14047 - protein, 191 aa, Homo Sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 14048 - protein, 174 aa, Homo Sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKM

SEQ ID NO: 14049 - protein, 323 aa, Homo Sapiens
  misc_feature (1)..(1): Xaa can be any naturally occurring amino acid
XRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVCDKPRR

SEQ ID NO: 14050 - protein, 207 aa, Homo Sapiens
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDRAATPHHRPQPRSVPGWDSAPGAPSPADITHPTPAPGPSAHAAPSTTSALTPGPAAAAADAAASSVAKGGA

SEQ ID NO: 14051 - protein, 188 aa, Homo Sapiens
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDSPRPLCPRCTQHHQRPDPRTCRCRCRRRSFLRCQGRGLELNPDTCRCRKLRR

SEQ ID NO: 14052 - protein, 32 aa, Homo Sapiens
  misc_feature (1)..(1): Xaa can be any naturally occurring amino acid
XHAAPSTTSALTPGPAAAAADAAASSVAKGGA

SEQ ID NO: 14053 - protein, 419 aa, Homo Sapiens
MHLLGFFSVACSLLAAALLPGPREAPAAAAAFESGLDLSDAEPDAGEATAYASKDLEEQLRSVSSVDELMTVLYPEYWKMYKCQLRKGGWQHNREQANLNSRTEETIKFAAAHYNTEILKSIDNEWRKTQCMPREVCIDVGKEFGVATNTFFKPPCVSVYRCGGCCNSEGLQCMNTSTSYLSKTLFEITVPLSQGPKPVTISFANHTSCRCMSKLDVYRQVHSIIRRSLPATLPQCQAANKTCPTNYMWNNHICRCLAQEDFMFSSDAGDDSTDGFHDICGPNKELDEETCQCVCRAGLRPASCGPHKELDRNSCQCVCKNKLFPSQCGANREFDENTCQCVCKRTCPRNQPLNPGKCACECTESPQKCLLKGKKFHHQTCSCYRRPCTNRQKACEPGFSYSEEVCRCVPSYWKRPQMS

SEQ ID NO: 14054 - protein, 354 aa, Homo Sapiens
MYREWVVVNVFMMLYVQLVQGSSNEHGPVKRSSQSTLERSEQQIRAASSLEELLRITHSEDWKLWRCRLRLKSFTSMDSRSASHRSTRFAATFYDIETLKVIDEEWQRTQCSPRETCVEVASELGKSTNTFFKPPCVNVFRCGGCCNEESLICMNTSTSYISKQLFEISVPLTSVPELVPVKVANHTGCKCLPTAPRHPYSIIRRSIQIPEEDRCSHSKKLCPIDMLWDSNKCKCVLQEENPLAGTEDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 14055 - protein, 615 aa, Homo Sapiens
MKALRLSASALFCLLLINGLGAAPPGRPEAQPPPLSSEHKEPVAGDAVPGPKDGSAPEVRGARNSEPQDEGELFQGVDPRALAAVLLQALDRPASPPAPSGSQQGPEEEAAEALLTETVRSQTHSLPAPESPEPAAPPRPQTPENGPEASDPSEELEALASLLQELRDFSPSSAKRQQETAAAETETRTHTLTRVNLESPGPERVWRASWGEFQARVPERAPLPPPAPSQFQARMPDSGPLPETHKFGEGVSSPKTHLGEALAPLSKAYQGVAAPFPKARRPESALLGGSEAGERLLQQGLAQVEAGRRQAEATRQAAAQEERLADLASDLLLQYLLQGGARQRGLGGRGLQEAAEERESAREEEEAEQERRGGEERVGEEDEEAAEAEAEAEEAERARQNALLFAEEEDGEAGAEDKRSQEETPGHRRKEAEGTEEGGEEEDDEEMDPQTIDSLIELSTKLHLPADDVVSIIEEVEEKRKRKKNAPPEPVPPPRAAPAPTHVRSPQPPPPAPAPARDELPDWNEVLPPWDREEDEVYPPGPYHPFPNYIRPRTLQPPSALRRRHYHHALPPSRHYPGREAQARRAQEEAEAEERRLQEQEELENYIEHVLLRRP

SEQ ID NO: 14056 - protein, 615 aa, Homo Sapiens; identical to SEQ ID NO: 14055

SEQ ID NO: 14057 - protein, 377 aa, Homo Sapiens
MKALRLSASALFCLLLINGLGAAPPGRPEAQPPPLSSEHKEPVAGDAVPGPKDGSAPEVRGARNSEPQDEGELFQGVDPRALAAVLLQALDRPASPPAPSGSQQGPEEEAAEALLTETVRSQTHSLPAPESPEPAAPPRPQTPENGPEASDPSEELEALASLLQELRDFSPSSAKRQQETAAAETETRTHTLTRVNLESPGPERVWRASWGEFQARVPERAPLPPPAPSQFQARMPDSGPLPETHKFGEGVSSPKTHLGEALAPLSKAYQGVAAPFPKARRPESALLGGSEAGERLLQQGLAQVEAGRRQAEATRQAAAQEERLADLASDLLLQFAAGRGPAARPCPLALPLSPGCVGTCQTPLPGPEPELPELTRG

SEQ ID NO: 14058 - protein, 169 aa, Homo Sapiens
MDTRNKAQLLVLLTLLSVLFSQTSAWPLYRAPSALRLGDRIPFEGANEPDQVSLKEDIDMLQNALAENDTPYYDVSRNARHADGVFTSDFSKLLGQLSAKKYLESLMGKRVSNISEDPVPVKRHSDAVFTDNYTRLRKQMAVKKYLNSILNGKRSSEGESPDFPEELEK

SEQ ID NO: 14059 - protein, 170 aa, Homo Sapiens
MDTRNKAQLLVLLTLLSVLFSQTSAWPLYRAPSALRLGDRIPFEGANEPDQVSLKEDIDMLQNALAENDTPYYDVSRNARHADGVFTSDFSKLLGQLSAKKYLESLMGKRVSSNISEDPVPVKRHSDAVFTDNYTRLRKQMAVKKYLNSILNGKRSSEGESPDFPEELEK

SEQ ID NO: 14060 - protein, 119 aa, Homo Sapiens
  misc_feature (1)..(1): Xaa can be any naturally occurring amino acid
XVSLKEDIDMLQNALAENDTPYYDVSRNARHADGVFTSDFSKLLGQLSAKKYLESLMGKRVSSNISEDPVPVKRHSDAVFTDNYTRLRKQMAVKKYLNSILNGKRSEGESPDFPEELEK

SEQ ID NO: 14061 - protein, 422 aa, Homo Sapiens
MPLWEAPSDHPANPPATLQGHTSLPGCQEEPARDPQSGLPQITSESSSFSEGSLPSWSSGPAGAKLNASHEGIGSSSDGNGDSKAATERVVSAMDTVRRKHPEITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 14062 - protein, 438 aa, Homo Sapiens
MRTLLPPALLTCWLLAPVNSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 14063 - protein, 77 aa, Homo Sapiens
MRTLLPPALLTCWLLAPVNSIHPECRFHLEIQEEETKCAELLRSQTEKHKGHTKGFILIHAGGLKRILDPHTYPLAP

SEQ ID NO: 14064 - protein, 579 aa, Homo Sapiens
MRTLLPPALLTCWLLAPVSAPATPAPRRLGPGSPLPRRALLPPVFAFLPGAGARAGSGRGSGVARGPELPPGEREALSSGPAGLRDSGWEAACALPRAPPSGVCWKRDRFFLDASTMSSFGAVPGAGSCGRLRGLRVSRGDRGWRWPQMPLGPSLYLLVNSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 14065 - protein, 347 aa, Homo Sapiens
MGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 14066 - protein, 630 aa, Homo Sapiens
MRTVVLTMKASVIEMFLAVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMGEMDSWKPGSVLLDEGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 14067 - protein, 657 aa, Homo Sapiens
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLDCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 14068 - protein, 693 aa, Homo Sapiens
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLGEMDSWKPGSVLLDEGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 14069 - protein, 678 aa, Homo Sapiens
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 14070 - protein, 656 aa, Homo Sapiens
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 14071 - protein, 203 aa, Homo Sapiens
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGKCSRVIESKPSESMNTRRVLGDSGEINILTGQAPLALAIF

SEQ ID NO: 14072 - protein, 134 aa, Homo Sapiens
  misc_feature (1)..(1): Xaa can be any naturally occurring amino acid
XTSSQNRPRADPGIQRQDPSGAAFQKPVGADVSLGLVPKEELSTQSLEPVSLGDPNCKIDLSFLIDGSTSIGKRRFRIQKQLLADVAQALDIGPAGPLMGVVQYGPLHWYWKNSPGNGEEWVGRETAPISQLST

SEQ ID NO: 14073 - protein, 92 aa, Homo Sapiens
MGSTWGSPGWVRLALCLTGLVLSLYALHVKAARARDRDYRALCDVGTAISCSRVFSSRLPADTLGLCPDAAELPGVSRWFCLPGLDPVLRAL

SEQ ID NO: 14074 - protein, 149 aa, Homo Sapiens
MGSTWGSPGWVRLALCLTGLVLSLYALHVKAARARDRDYRALCDVGTAISCSRVFSSRVQGTGLTVLTWFHPTPPLCQVGQGFRAGGACAGTGQHPQSIQQHIRLHLLHTTAIVRLPADTLGLCPDAAELPGVSRWFCLPGLDPVLRAL

SEQ ID NO: 14075 - protein, 156 aa, Homo Sapiens
MGSTWGSPGWVRLALCLTGLVLSLYALHVKAARARDRDYRALCDVGTAISCSRVFSSRWGRGFGLVEHVLGQDSILNQSNSIFGCIFYTLQLLLDGVSPCCPGWSQAICLPQPPKVLGGLQALPADTLGLCPDAAELPGVSRWFCLPGLDPVLRAL

SEQ ID NO: 14076 - protein, 163 aa, Homo Sapiens
MGSTWGSPGWVRLALCLTGLVLSLYALHVKAARARDRDYRALCDVGTAISCSRVFSSRWGRGFGLVEHVLGQDSILNQSNSIFGCIFYTLQLLLGCLRTRWASVLMLLSSLVSLAGSVYLAWILFFVLYDFCIVCITTYAINVSLMWLSFRKVQEPQGKAKRH

SEQ ID NO: 14077 - protein, 160 aa, Homo Sapiens
MIILESGIGVPGERTRGWTARGVVAQGLSYPAILVFEIRVRGKGPDSAGDWDYSGDSHVNWMPRNNGDQERRGGRMAVEIDDGLKDGAQVGQGFRAGGACAGTGQHPQSIQQHIRLHLLHTTAIVRLPADTLGLCPDAAELPGVSRWFCLPGLDPVLRAL

SEQ ID NO: 14078 - protein, 161 aa, Homo Sapiens
MIVERLGYCQGCVWPKEWFCECMGERETDHQEALVRQDPGGWEAAARMVPEIVSGEMLGSRIGSPYSLDPLIRWSLGPGCCNSYNRTWHRVGQGFRAGGACAGTGQHPQSIQQHIRLHLLHTTAIVRLPADTLGLCPDAAELPGVSRWFCLPGLDPVLRAL

SEQ ID NO: 14079 - protein, 43 aa, Homo Sapiens
MLLSSLVSLAGSVYLAWILFFVLYDFCIVCITTYAINVSLMWL

SEQ ID NO: 14080 - protein, 92 aa, Homo Sapiens
  misc_feature (1)..(1): Xaa can be any naturally occurring amino acid
XQGCVWPKEWFCECMGERETDHQEALVRQDPGGWEAAARMVPEIVSGEMLGSRIGSPYSLDPLIRWSLGPGCCNSYNRTWHRVACGHAGPLS

SEQ ID NO: 14081 - protein, 845 aa, Homo Sapiens
MGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQRINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 14082 - protein, 873 aa, Homo Sapiens
MGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQSTATTVTYSETKDTNTTEISATSGLVPGGINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 14083 - protein, 173 aa, Homo Sapiens
MGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCRNITCSPDEFTCSSGRCISRNFVCNGQDDCSDGSDELDCAPPTCGAHEFQCSTSSCIPISWVCDD

SEQ ID NO: 14084 - protein, 70 aa, Homo Sapiens
MERGAGAKLLPLLLLLRATGFTCAQTDGRNGYTAVIEVTSGGPWGDWAWPEMCPDGFFASGFSLKLGRME

SEQ ID NO: 14085 - protein, 102 aa, Homo Sapiens
MERGAGAKLLPLLLLLRATGFTCAQTDGRNGYTAVIEVTSGGPWGDWAWPEMCPDGFFASGFSLKVEPPQGIPGDDTALNGIRLHCARGNVLGNTHVLGRME

SEQ ID NO: 14086 - protein, 114 aa, Homo Sapiens
MERGAGAKLLPLLLLLRATGFTCAQTDGRNGYTAVIEVTSGGPWGDWAWPEMCPDGFFASGFSLKVEPPQGIPGDDTALNGIRLHCARGNVLGNTHVVESQSGRWGAGVEDPLG

SEQ ID NO: 14087 - protein, 202 aa, Homo Sapiens
MERGAGAKLLPLLLLLRATGFTCAQTDGRNGYTAVIEVTSGGPWGDWAWPEMCPDGFFASGFSLKVEPPQGIPGDDTALNGIRLHCARGNVLGNTHVVESQSGSWGEWSEPLWCRGGAYLVAFSLRVEAPTTLGDNTAANNVRFRCSDGEELQGPGLSWGDFGDWSDHCPKGACGLQTKIQGPRGLGDDTALNDARLFCCRS

SEQ ID NO: 14088 - protein, 513 aa, Homo Sapiens
MTTQLPAYVAILLFYVSRASCQDTFTAAVYEHAAILPNATLTPVSREEALALMNRNLDILEGAITSAADQGAHIIVTPEDAIYGWNFNRDSLYPYLEDIPDPEVNWIPCNNRNRFGQTPVQERLSCLAKNNSIYVVANIGDKKPCDTSDPQCPPDGRYQYNTDVVFDSQGKLVARYHKQNLFMGENQFNVPKEPEIVTFNTTFGSFGIFTCFDILFHDPAVTLVKDFHVDTIVFPTAWMNVLPHLSAVEFHSAWAMGMRVNFLASNIHYPSKKMTGSGIYAPNSSRAFHYDMKTEEGKLLLSQLDSHPSHSAVVNWTSYASSIEALSSGNKEFKGTVFFDEFTFVKLTGVAGNYTVCQKDLCCHLSYKMSENIPNEVYALGAFDGLHTVEGRYYLQICTLLKCKTTNLNTCGDSAETASTRFEMFSLSGTFGTQYVFPEVLLSENQLAPGEFQVSTDGRLFSLKPTSGPVLTVTLFGRLYEKDWASNASSGLTAQARIIMLIVIAPIVCSLSW

SEQ ID NO: 14089 - protein, 102 aa, Homo Sapiens
MNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPP

SEQ ID NO: 14090 - protein, 131 aa, Homo Sapiens
MNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKVGKSH

SEQ ID NO: 14091 - protein, 467 aa, Homo Sapiens
MNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTGSGIYAPNGPKVYHYDMKTELGKLLLSEVDSHPLSSLAYPTAVNWNAYATTIKPFPVQKNTFRGFISRDGFNFTELFENAGNLTVCQKELCCHLSYRMLQKEENEVYVLGAFTGLHGRRRREYWQVCTLLKCKTTNLTTCGRPVETASTRFEMFSLSGTFGTEYVFPEVLLTEIHLSPGKFEVLKDGRLVNKNGSSGPILTVSLFGRWYTKDSLYSSCGTSNSAITYLLIFILLMIIALQNIVML

SEQ ID NO: 14092 - protein, 101 aa, Homo Sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIP

SEQ ID NO: 14093 - protein, 166 aa, Homo Sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVV

SEQ ID NO: 14094 - protein, 192 aa, Homo Sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKETLQSVKRSFAVI

SEQ ID NO: 14095 - protein, 195 aa, Homo Sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKEVVFMHQMVPKCIIMT

SEQ ID NO: 14096 - protein, 299 aa, Homo Sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKVCTLLKCKTTNLTTCGRPVETASTRFEMFSLSGTFGTEYVFPEVLLTEIHLSPGKFEVLKDGRLVNKNGSSGPILTVSLFGRWYTKDSLYSSCGTSNSAITYLLIFILLMIIALQNIVML

SEQ ID NO: 14097 - protein, 184 aa, Homo Sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKVGKSH

SEQ ID NO: 14098 - protein, 520 aa, Homo Sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTGSGIYAPNGPKVYHYDMKTELGKLLLSEVDSHPLSSLAYPTAVNWNAYATTIKPFPVQKNTFRGFISRDGFNFTELFENAGNLTVCQKELCCHLSYRMLQKEENEVYVLGAFTGLHGRRRREYWQVCTLLKCKTTNLTTCGRPVETASTRFEMFSLSGTFGTEYVFPEVLLTEIHLSPGKFEVLKDGRLVNKNGSSGPILTVSLFGRWYTKDSLYSSCGTSNSAITYLLIFILLMIIALQNIVML

SEQ ID NO: 14099 - protein, 290 aa, Homo Sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTVVFMHQMVPKCIIMT

SEQ ID NO: 14100 - protein, 219 aa, Homo Sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRKWYLCTKWSQSVSL

SEQ ID NO: 14101 - protein, 216 aa, Homo Sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGSLDERFAPFDSY

SEQ ID NO: 14102 - protein, 119 aa, Homo Sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRSAHC

SEQ ID NO: 14103 - protein, 129 aa, Homo Sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWREWNLRPRSSQGVPL

SEQ ID NO: 14104 - protein, 129 aa, Homo Sapiens; identical to SEQ ID NO: 14103

SEQ ID NO: 14105 - protein, 207 aa, Homo Sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRFGNTPVQQRLSCLAKDNSIYVVANIGDKKPCNASDSQCPPDGRYQYNTDVVFDSQGKLLARYHKGVESTPQKQSRCTTMTWKQRVVSCCYQN

SEQ ID NO: 14106 - protein, 274 aa, Homo Sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRFGNTPVQQRLSCLAKDNSIYVVANIGDKKPCNASDSQCPPDGRYQYNTDVVFDSQGKLLARYHKYNLFAPEIQFDFPKDSELVTFDTPFGKFGIFTCFDIFSHDPAVVVVDEFQLTAFSTPQHGTTRCPSSRLFPSIQHGPRPWESIYLLQIPTTPACT

SEQ ID NO: 14107 - protein, 147 aa, Homo Sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRKSKKMNEPVSKELCYHCHSECNQYGQWKLYRT

SEQ ID NO: 14108 - protein, 117 aa, Homo Sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRNH

SEQ ID NO: 14109 - protein, 117 aa, Homo Sapiens; identical to SEQ ID NO: 14108

SEQ ID NO: 14110 - protein, 117 aa, Homo Sapiens; identical to SEQ ID NO: 14108

SEQ ID NO: 14111 - protein, 133 aa, Homo Sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWSTIFLHLKFSLISPRIQNL

SEQ ID NO: 14112 - protein, 169 aa, Homo Sapiens
MIISHFPKCVAVFALLALSVGALDTFIAAVYEHAVILPNRTETPVSKEEALLLMNKNIDVLEKAVKLAAKQQGAHIIVTPEDGIYGWIFTRESIYPYLEDIPDPGVNWIPCRDPWSMVQHAAPPLGCSLPFSMGQGHGSQSTCCKYPQHQHAHDREWNLRPRSSQGVPL

SEQ ID NO: 14113 - protein, 161 aa, Homo Sapiens
MIISHFPKCVAVFALLALSVGALDTFIAAVYEHAVILPNRTETPVSKEEALLLMNKNIDVLEKAVKLAAKQVLPFYTCKGDLQFGQRVFGIHDKLFCPTCFEQGAHIIVTPEDGIYGWIFTRESIYPYLEDIPDPGVNWIPCRDPWREWNLRPRSSQGVPL

SEQ ID NO: 14114 - protein, 60 aa, Homo Sapiens
  misc_feature (1)..(1): Xaa can be any naturally occurring amino acid
XTRESIYPYLEDIPDPGVNWIPCRDPWRKSKKMNEPVSKELCYHCHSECNQYGQWKLYRT

SEQ ID NO: 14115 - protein, 155 aa, Homo Sapiens
MCTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 14116 - protein, 109 aa, Homo Sapiens
MFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 14117 - protein, 169 aa, Homo Sapiens
MLSETLGYLSSVLLQCTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 14118 - protein, 22 aa, Homo Sapiens
MMGVLFCCGAGFFIRRRMYPPP

SEQ ID NO: 14119 - protein, 53 aa, Homo Sapiens
MMGVLFCCGAGFFIRRRMYPPPLIEEPAFNVSYTRQPPNPGPGAQQPGPPYYT

SEQ ID NO: 14120 - protein, 85 aa, Homo Sapiens
MMGVLFCCGAGFFIRRRMYPPPLIEEPAFNVSYTRQPPNPGPGAQQPGPPYYTDPGGPGMNPVGNSMAMAFQVPPNSPQGSVACP

SEQ ID NO: 14121 - protein, 96 aa, Homo Sapiens
MMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPP

SEQ ID NO: 14122 - protein, 105 aa, Homo Sapiens
MMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 14123 - protein, 105 aa, Homo Sapiens; identical to SEQ ID NO: 14122

SEQ ID NO: 14124 - protein, 105 aa, Homo Sapiens; identical to SEQ ID NO: 14122

SEQ ID NO: 14125 - protein, 170 aa, Homo Sapiens
MRIRSLHPVQQTEPTTCTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 14126 - protein, 172 aa, Homo Sapiens
MRRQPAKVAALLLGLLLECTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 14127 - protein, 163 aa, Homo Sapiens
MRRTGSHAQCTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 14128 - protein, 144 aa, Homo Sapiens
MSAPCPGLLSCSCCLSTAQPVLHQPPAMSSALGTTIRLTCTLRNDHDIGVYSVYWYQQRPGHPPRFLLRYFSQSDKSQGPQVPPRFSGSKDVARNRGYLSISELQPEDEAMYYCAMGARSSEKEEREREWEEEMEPTAARTRVP

SEQ ID NO: 14129 - protein, 145 aa, Homo Sapiens
MSWAPVLLMLFVYCTGCGPQPVLHQPPAMSSALGTTIRLTCTLRNDHDIGVYSVYWYQQRPGHPPRFLLRYFSQSDKSQGPQVPPRFSGSKDVARNRGYLSISELQPEDEAMYYCAMGARSSEKEEREREWEEEMEPTAARTRVP

SEQ ID NO: 14130 - protein, 107 aa, Homo Sapiens
MACRCLSFLLMGTFLSGQVAQLSCTLSPQHVTIRDYGVSWYQQRAGSAPRYLLYYRSEEDHHRPADIPDRFSAAKDEAHNACVLTISPVQPEDDADYYCSVGYGFSP

SEQ ID NO: 14131 - protein, 123 aa, Homo Sapiens
MACRCLSFLLMGTFLSVSQTVLAQLDALLVFPGQVAQLSCTLSPQHVTIRDYGVSWYQQRAGSAPRYLLYYRSEEDHHRPADIPDRFSAAKDEAHNACVLTISPVQPEDDADYYCSVGYGFSP

SEQ ID NO: 14132 - protein, 271 aa, Homo Sapiens
MAGAGSEARFAGLSLVQLNELLEDEGQLTEMVQKMEENVQLNKEMTLASNRSLAEGNLLYQPQLDTLKARLTQKYQELQVLFEAYQIKKTKLDRQSSSASLETLLALLQAEGAKIEEDTENMAEKFLDGELPLDSFIDVYQSKRKLAHMRRVKIEKLQEMVLKGQRLPQALAPLPPRLPELAPTAPLPYPAPEASGPPAVAPRRIPPPPPPVPAGRLATPFTAAMSSGQAVPYPGLQCPPLPPRVGLPTQQGFSSQFVSPYPPPLPQRPPP

SEQ ID NO: 14133 - protein, 285 aa, Homo Sapiens
MAGAGSEARFAGLSLVQLNELLEDEGQLTEMVQKMEETQNVQLNKEMTLASNRSLAEGNLLYQPQLDTLKARLTQKYQELQVLFEAYQIKKTKLDRQSSSASLETLLALLQAEGAKIEEDTENMAEKFLDGELPLDSFIDVYQSKRKLAHMRRVKIEKLQEMVLKGQRLPQALAPLPPRLPELAPTAPLPYPAPEASGPPAVAPRRIPPPPPPVPAGRLATPFTAAMSSGQAVPYPGLQCPPLPPRVGLPTQQGFSSQFVSPYPPPLPQRPPPRLPPHQPGFILQ

SEQ ID NO: 14134 - protein, 184 aa, Homo Sapiens
MQSGCVLELRNAGLVACLALITVFVAECCYGDSCQTQNVQLNKEMTLASNRSLAEGNLLYQPQLDTLKARLTQKYQELQVLFEAYQIKKTKLDRQSSSASLETLLALLQAEGAKIEEDTENMAEKFLDGELPLDSFIDVYQSKRKLAHMRRVKIEKLQEMVLKGQRLPQALAPLPPRLPELAPT

SEQ ID NO: 14135 - protein, 334 aa, Homo Sapiens
MAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDEMDRLATNMAVITDFSARISATLQDRHERITKLAGGRCRAGPAVGLSWGSGANVTLRPPGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGS

SEQ ID NO: 14136 - protein, 782 aa, Homo Sapiens
MAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFARQLGSRYFALVERRLAQEQGGGDNSLLVRALDRFHRRLRAPGALLAAAGLADAATEIVERVARERLGHHLQGLRAAFLGCLTDVRQALAAPRVAGKEGPGLAELLANVASSILSHIKASLAAVHLFTAKEVSFSNKPYFRGEFCSQGVREGLIVGFVHSMCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 14137 - protein, 163 aa, Homo Sapiens
MAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATGSALDTQMRLGASGPCLGCLWSDGAVEAQWWQLAKHLRPASDLD

SEQ ID NO: 14138 - protein, 233 aa, Homo Sapiens
MAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEK

SEQ ID NO: 14139 - protein, 81 aa, Homo Sapiens
MAAAAAAGPSPGSGPGDSPEGPEGEAPERRRKAHGMLKLYYGLSEGEAAGRPAGPDPLDPTDLNGAHFDPEVYLDKTPSGR

SEQ ID NO: 14140 - protein, 81 aa, Homo Sapiens [sequence omitted]

SEQ ID NO: 14141 - protein, 110 aa, Homo Sapiens
MDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAY

SEQ ID NO: 14142 - protein, 255 aa, Homo Sapiens
MDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFA

SEQ ID NO: 14143 - protein, 165 aa, Homo Sapiens
MIMPLYSKLGDREKKKRKEKASRPWAAVGTMAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDE

SEQ ID NO: 14144 - protein, 99 aa, Homo Sapiens
VGLLYEEGVRKAQSSDSSKRTFSVYSSSRQQGRYAPSYTPSAPMDTNLLSNIQKLFSERIDVFSPVEFNKMTALILYPSLLIWPRRLSASSQLLPSCRC

SEQ ID NO: 14145 - protein, 72 aa, Homo Sapiens
  misc_feature (1)..(1): Xaa can be any naturally occurring amino acid
XSQGVREGLIVGFVHSMCQTAQSFCDSPGEKGGATPPALLLLLSRLCLDYETATISYILTLTDEQFLVQVKH

SEQ ID NO: 14146 - protein, 199 aa, Homo Sapiens
  misc_feature (1)..(1): Xaa can be any naturally occurring amino acid
XTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVRLPT

SEQ ID NO: 14147 - protein, 168 aa, Homo Sapiens
MVFAFWKVFLILSCLAGQVSVVQVTIPDGFVNVTVGSNVTLICIYTTTVASREQLSIQWSFFHKKEMEPISHSSCLSTEGMEEKAVSQCLKMTHARDARGRCSWTSEIYFSQGGQAVAIGQFKDRITGSNDPGNASITISHMQPADSGIYICDVNNPPDFLGQNQGIL

SEQ ID NO: 14148 - protein, 423 aa, Homo Sapiens
MVFAFWKVFLILSCLAGQVSVVQVTIPDGFVNVTVGSNVTLICIYTTTVASREQLSIQWSFFHKKEMEPISHSSCLSTEGMEEKAVSQCLKMTHARDARGRCSWTSEIYFSQGGQAVAIGQFKDRITGSNDPGNASITISHMQPADSGIYICDVNNPPDFLGQNQGILNVSVLVKPSKPLCSVQGRPETGHTISLSCLSALGTPSPVYYWHKLEGRDIVPVKENFNPTTGILVIGNLTNFEQGYYQCTAINRLGNSSCEIDLTSSHPEVGIIVGALIGSLVGAAIIISVVCFARNKAKAKAKERNSKTIAELEPMTKINPRGESEAMPREDATQLEVTLPSSIHETGPDTIQEPDYEPKPTQEPAPEPAPGSEPMAVPDLDIELELEPETQSELEPEPEPEPESEPGVVVEPLSEDEKGVVKA

SEQ ID NO: 14149 - protein, 387 aa, Homo Sapiens
MVFAFWKVFLILSCLAGQVSVVQVTIPDGFVNVTVGSNVTLICIYTTTVASREQLSIQWSFFHKKEMEPISIYFSQGGQAVAIGQFKDRITGSNDPGNASITISHMQPADSGIYICDVNNPPDFLGQNQGILNVSVLVKPSKPLCSVQGRPETGHTISLSCLSALGTPSPVYYWHKLEGRDIVPVKENFNPTTGILVIGNLTNFEQGYYQCTAINRLGNSSCEIDLTSSHPEVGIIVGALIGSLVGAAIIISVVCFARNKAKAKAKERNSKTIAELEPMTKINPRGESEAMPREDATQLEVTLPSSIHETGPDTIQEPDYEPKPTQEPAPEPAPGSEPMAVPDLDIELELEPETQSELEPEPEPEPESEPGVVVEPLSEDEKGVVKA

SEQ ID NO: 14150 - protein, 190 aa, Homo Sapiens
MAAGGSAPEPRVLVCLGALLAGWVAVGLEAVVIGEVHENVTLHCGNISGLRGQVTWYRNNSEPVFLLSSNSSLRPAEPRFSLVDATSLHIESLSLGDEGIYTCQEILNVTQWFQVWLQVANPPPSAPQCWAQMASGSFMLQLTCRWDGGYPDPDFLWIEEPGGVIVGKSKLGVEMLSESQLSDGKKFKCV

SEQ ID NO: 14151 - protein, 540 aa, Homo Sapiens
MAAGGSAPEPRVLVCLGALLAGWVAVGLEAVVIGEVHENVTLHCGNISGLRGQVTWYRNNSEPVFLLSSNSSLRPAEPRFSLVDATSLHIESLSLGDEGIYTCQEILNVTQWFQVWLQVASGPYQIEVHIVATGTLPNGTLYAARGSQVDFSCNSSSRPPPVVEWWFQALNSSSESFGHNLTVNFFSLLLISPNLQGNYTCLALNQLSKRHRKVTTELLVYYPPPSAPQCWAQMASGSFMLQLTCRWDGGYPDPDFLWIEEPGGVIVGKSKLGVEMLSESQLSDGKKFKCVTSHIVGPESGASCMVQIRGPSLLSEPMKTCFTGGNVTLTCQVSGAYPPAKILWLRNLTQPEVIIQPSSRHLITQDGQNSTLTIHNCSQDLDEGYYICRADSPVGVREMEIWLSVKEPLNIGGIVGTIVSLLLLGLAIISGLLLHYSPVFCWKVGNTSRGQNMDDVMVLVDSEEEEEEEEEEEEDAAVGEQEGAREREELPKEIPKQDHIHRVTALVNGNIEQMGNGFQDLQDDSSEEQSDIVQEEDRPV

SEQ ID NO: 14152 - protein, 126 aa, Homo Sapiens
EFPFTDLKPKDAGRYFCAYKTTASHEWSESSEHLQLVVTDKHDELEAPSMKTGSSSEESTKRTSHSKLPEQEAAEADLSNMERVSLSTADPQGVTYAELSTSALSEAASDTTQEPPGSHEYAALKV

SEQ ID NO: 14153 - protein, 116 aa, Homo Sapiens
MTAEFLSLLCLDTRTIFVAIFSCISILLLFLSVFIIYRCSQHSSSSEESTKRTSHSKLPEQEAAEADLSNMERVSLSTADPQGVTYAELSTSALSEAASDTTQEPPGSHEYAALKV

SEQ ID NO: 14154 - protein, 174 aa, Homo Sapiens
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTDTRTIFVAIFSCISILLLFLSVFIIYRCSQHSELRERKGREGE

SEQ ID NO: 14155 - protein, 236 aa, Homo Sapiens
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTDTRTIFVAIFSCISILLLFLSVFIIYRCSQHSSSSEESTKRTSHSKLPEQEAAEADLSNMERVSLSTADPQGVTYAELSTSALSEAASDTTQEPPGSHEYAALKV

SEQ ID NO: 14156 - protein, 205 aa, Homo Sapiens
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTGSSSEESTKRTSHSKLPEQEAAEADLSNMERVSLSTADPQGVTYAELSTSALSEAASDTTQEPPGSHEYAALKV

SEQ ID NO: 14157 - protein, 143 aa, Homo Sapiens
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTVAHVCNTRTLGR

SEQ ID NO: 14158 - protein, 229 aa, Homo Sapiens
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTGSLPEPLLSVNVDPGMTPGLRTLRCLTPYNGTECIVIALLKMGIPEPLQVRQVRKNQTDFMLWNVTSNDSGNYSCVYYLSNSSHLASFPSNKLEIWVTDKHDELEAPSMKT

SEQ ID NO: 14159 - protein, 240 aa, Homo Sapiens
MMGIFLVYVGFVFFSVLYVQQGLSSQAKFTEFPRNVTATEGQNVEMSCAFQSGSASVYLEIQWWFLRGPEDLDPGAEGAGAQVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSAKSKSPVKSTERTAKLTLNSKHHPAPTVL

SEQ ID NO: 14160 - protein, 236 aa, Homo Sapiens
MMGIFLVYVGFVFFSVLYVQQGLSSQAKFTEFPRNVTATEGQNVEMSCAFQSGSASVYLEIQWWFLRGPEDLDPGAEGAGAQVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSGARIATSHGLSVLLLVCGFVKGALL

SEQ ID NO: 14161 - protein, 244 aa, Homo Sapiens
MMGIFLVYVGFVFFSVLYVQQGLSSQAKFTEFPRNVTATEGQNVEMSCAFQSGSASVYLEIQWWFLRGPEDLDPGAEGAGAQVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSGMETHFEPFILPLTNAPQKGQSYRVDRFMNGDF

SEQ ID NO: 14162 - protein, 309 aa, Homo Sapiens
MMGIFLVYVGFVFFSVLYVQQGLSSQAKFTEFPRNVTATEGQNVEMSCAFQSGSASVYLEIQWWFLRGPEDLDPGAEGAGAQVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSVSPILPEVKHLHRPPLLVLPFFSLSSLFSTDPLPTFPTSHRTVKRLPAPLPQPGHGSTPGVQSCVLAPPAKSKSPVKSTERTAKLTLNSKHHPAPTVL

SEQ ID NO: 14163 - protein, 285 aa, Homo Sapiens
MEQRNRLGALGYLPPLLLHALLLFVADAAFTEVPKDVTVREGDDIEMPCAFRASGATSYSLEIQWWYLKEPPRELLHELALSVPGARSKVTNKDATKISTVRVQGNDISHRLRLSAVRLQDEGVYECRVSDYSDDDTQEHKAQAMLRVLSRFAPPNMQAAEAVSHIQSSGPRRHGPASAANANNAGAASRTTSEPGRGDKSPPPGSPPAAIDPAVPEAAAASAAHTPTTTVAAAAAASSASPPSGQAVLLRQRHGSGTGRSYTTDPLLSLLLLALHKFLRLLLGH

SEQ ID NO: 14164 - protein, 204 aa, Homo Sapiens
MGAPLAVALGALHYLALFLQLGGATRPAGHAPWDNHVSGHALFTETPHDMTARTGEDVEMACSFRGSGSPSYSLEIQWWYVRSHRDWTDKQAWASNQLKASQQEDAGKEATKISVVKVVGSNISHKLRLSRVKPTDEGTYECRVIDFSDGKARHHKVKAYLRVQPGENSVLHLPEAPPAAPAPPPPKPGKELRKRSVDQEACSL

SEQ ID NO: 14165 - protein, 149 aa, Homo Sapiens
MGAPLAVALGALHYLALFLQLGGATRPAGHAPWDNHVSGHALFTETPHDMTARTGEDVEMACSFRGSGSPSYSLEIQWWYVRSHRDWTDKQAWASNQVVKVVGSNISHKLRLSRVKPTDEGTYECRVIDFSDGKARHHKVKAYLRVQPG

SEQ ID NO: 14166 - protein, 132 aa, Homo Sapiens
MGAPLAVALGALHYLALFLQLGGATRPAGHAPWDNHVSGHGGQGGGQQHLPQAAPVPGEAHGRRHLRVPRHRLQRRQGPAPQGQGLPAGAARGELRPASARSPSRRARPAAPQARQGAEEALGGPGGLQPLD

SEQ ID NO: 14167 - protein, 191 aa, Homo Sapiens
MRLLALAAAALLARAPAPEVCAALNVTVSPGPVVDYLEGENATLLCHVSQKRRKDSLLAVRWFFAHSFDSQEALMVKMTKLRVVQYYGNFSRSAKRRRLRLLEEQRGALYRLSVLTLQPSDQGHYVCRVQEISRHRNKWTAWSNGSSATEMRGVSSHPVERGAFLGISLVILPHSLPFTADLTMASFLQSS

SEQ ID NO: 14168 - protein, 320 aa, Homo Sapiens
MRLLALAAAALLARAPAPEVCAALNVTVSPGPVVDYLEGENATLLCHVSQKRRKDSLLAVRWFFAHSFDSQEALMVKMTKLRVVQYYGNFSRSAKRRRLRLLEEQRGALYRLSVLTLQPSDQGHYVCRVQEISRHRNKWTAWSNGSSATEMRVISLKASEESSFEKTKETWAFFEDLYVYAVLVCCVGILSILLFMLVIVWQSVFNKRKSRVRHYLVKCPQNSSGETVTSVTSLAPLQPKKGKRQKEKPDIPPAVPAKAPIAPTFHKPKLLKPQRKVTLPKIAEENLTYAELELIKPHRAAKGAPTSTVYAQILFEENKL

SEQ ID NO: 14169 - protein, 118 aa, Homo Sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKP

SEQ ID NO: 14170 - protein, 478 aa, Homo Sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 14171 - protein, 167 aa, Homo Sapiens
MFLLDSSASVSHYEFSRVREFVGQLVAPLPLGTGALRASLVHVGSRPYTEFPFGQHSSGEAAQDAVRASAQRMGDTHTGLALVYAKEQLFAEASGARPGVPKVLVWVTDGGSSDPVGPPMQELKDLGVTVFIVSTGRGNFLELSAAASAPAEKHLHFVDVDDLHIIV

SEQ ID NO: 14172 - protein, 64 aa, Homo Sapiens
MLPWTALGLALSLRLALARSGAERGAQGPGRHRVHCQHRPRQLPGAVSRCLSPCREAPALCGRG

SEQ ID NO: 14173 - protein, 148 aa, Homo Sapiens
MLPWTALGLALSLRLALARSGAERGPLGEGKHPLKESWGPGGPCLAVGLSGGPTPEAEHSSFPPGPPASAPRGDLMFLLDSSASVSHYEFSRVREFVGQLVAPLPLGTGALRASLVHVGSRPYTEFPFGQHSSGEAAQDAVRASAQRM

SEQ ID NO: 14174 - protein, 445 aa, Homo Sapiens
MLPWTALGLALSLRLALARSGAERGPPASAPRGDLMFLLDSSASVSHYEFSRVREFVGQLVAPLPLGTGALRASLVHVGSRPYTEFPFGQHSSGEAAQDAVRASAQRMGDTHTGLALVYAKEQLFAEASGARPGVPKVLVWVTDGGSSDPVGPPMQELKDLGVTVFIVSTGRGNFLELSAAASAPAEKHLHFVDVDDLHIIVQELRGSILDAMRPQQLHATEITSSGFRLAWPPLLTADSGYYVLELVPSAQPGAARRQQLPGNATDWIWAGLDPDTDYDVALVPESNVRLLRPQILRVRTRPGEAGPGASGPESGAGPAPTQLAALPAPEEAGPERIVISHARPRSLRVSWAPALGSAAALGYHVQFGPLRGGEAQRVEVPAGRNCTTLQGLAPGTAYLVTVTAAFRSGRESALSAKACTPDGPRPRPRPVPRAPTPGTASREP

SEQ ID NO: 14175 - protein, 421 aa, Homo Sapiens
MEAHVFQKDWTATSASARWPLEGRLTVVALKLSLECRVDLLFLLDSSAGTTLDGFLRAKVFVKRFVRAVLSEDSRARVGVATYSRELLVAVPVGEYQDVPDLVWSLDGIPFRGGPTLTGSALRQAAERGFGSATRTGQDRPRRVVVLLTESHSEDEVAGPARHARARELLLLGVGSEAVRAELEEITGSPKHVMVYSDPQDLFNQIPELQGKLCSRQRPGCRTQALDLVFMLDTSASVGPENFAQMQSFVRSCALQFEVNPDVTQVGLVVYGSQVQTAFGLDTKPTRAAMLRAISQAPYLGGVGSAGTALLHIYDKVMTVQRGARPGVPKAVVVLTGGRGAEDAAVPAQKLRNNGISVLVVGVGPVLSEGLRRLAGPRDSLIHVAAYADLRYHQDVLIEWLCGGEWGNPHPQGCPHGRPSA

SEQ ID NO: 14176 - protein, 755 aa, Homo Sapiens
MPPFLLLEAVCVFLFSRVPPSLPLQEVHVSKETIGKISAASKMMWCSAAVDIMFLLDGSNSVGKGSFERSKHFAITVCDGLDISPERVRVGAFQFSSTPHLEFPLDSFSTQQEVKARIKRMVFKGGRTETELALKYLLHRGLPGGRNASVPQILIIVTDGKSQGDVALPSKQLKERGVTVFAVGVRFPRWEELHALASEPRGQHVLLAEQVEDATNGLFSTLSSSAICSSATPDCRVEAHPCEHRTLEMVREFAGNAPCWRGSRRTLAVLAAHCPFYSWKRVFLTHPATCYRTTCPGPCDSQPCQNGGTCVPEGLDGYQCLCPLAFGGEANCALKLSLECRVDLLFLLDSSAGTTLDGFLRAKVFVKRFVRAVLSEDSRARVGVATYSRELLVAVPVGEYQDVPDLVWSLDGIPFRGGPTLTGSALRQAAERGFGSATRTGQDRPRRVVVLLTESHSEDEVAGPARHARARELLLLGVGSEAVRAELEEITGSPKHVMVYSDPQDLFNQIPELQGKLCSRQRPGCRTQALDLVFMLDTSASVGPENFAQMQSFVRSCALQFEVNPDVTQVGLVVYGSQVQTAFGLDTKPTRAAMLRAISQAPYLGGVGSAGTALLHIYDKVMTVQRGARPGVPKAVVVLTGGRGAEDAAVPAQKLRNNGISVLVVGVGPVLSEGLRRLAGPRDSLIHVAAYADLRYHQDVLIEWLCGEAKQPVNLCKPSPCMNEGSCVLQNGSYRCKCRDGWEGPHCENRFLRRP

SEQ ID NO: 14177 - protein, 1024 aa, Homo Sapiens
MLVTGPCLLAGLESPSHALRADAPPHASSAATICVTLAEGHHCDRALEILLHPSEPHQPHLMLEGGSLSSAEYEARVRARRDFQRLQRRDSDGDRQVWFLQRRFHKDILLNPVLALSFCPDLSSKPGHLGTATRELLFLLDSSSVAHKDAIVLAVKSLPPQTLINLAVFGTLVQPLFPESRPCSDDAVQLICESIETLQVPSGPPDVLAALDWAVGQPQHRAYPRQLFLLTAASPMAATTHRTLELMRWHRGTARCFSFGLGPTCHQLLQGLSALSRGQAYFLRPGQRLQPMLVQALRKALEPALSDISVDWFVPDTVEALLTPREIPALYPGDQLLGYCSLFRVDGFRSRPPGGQEPGWQSSGGSVFPSPEEAPSAASPGTEPTGTSEPLGTGTVSAELSSPWAARDSEQTGTDALTDPVTDPGPNPSDTAIWRRIFQSSYIREQYVLTHCSASPEPGPGSTGSSESPGSQGPGSPEGSAPLEPPSQQGCRSLAWGEPAGSRSCPLPAPTPAPFKVGALSTEVLGRQHRAALAGRSLSSPPGRANQVPGRPRKPSLGAILDGPSPEPGQQLGQGLDDSGNLLSPAPMDWDMLMEPPFLFTAVPPSGELAPPAVPPQAPRCHVVIRGLCGEQPMCWEVGVGLETLWGPGDGSQPPSPPVREAAWDQALHRLTAASVVRDNEQLALRGGAETTADRGHARRCWLRALQTSKVSSAPSCFTCPVAVDATTREVLPGALQVCSSEPAEPPGTPPASHSHLDAAPLPTVVYSKGLQRGSPAGAWDSDQNGNSKRALGDPATPTEGPRRPPPRPPCRLSMGRRHKLCSPDPGQANNSEGSDHDYLPLVRLQEAPGSFRLDAPFCAAVRISQERLCRASPFAVHRASLSPTSASLPWALLGPGVGQGDSATASCSPSPSSGSEGPGQVDSGRGSDTEASEGAEGLGGTDLRGRTWATAVALAWLEHRCAAAFDEWELTAAKADCWLRAQHLPDGLDLAALKAAARGLFLLLRHWDQNLQLHLLCYSPANV

SEQ ID NO: 14178 - protein, 1242 aa, Homo Sapiens
MPGLYCPSSWTPLPLTDSWVRACANGPCLSVRARLTYRNPQPQPVDGVFVYPLAEAEVVSGFEAEAAGRRVSFQLQSRRRSQAACCRALGPGLGTPTPRRCAQGHLVLDLAQARSTLVLPTGIIAAAGTMTVTLHSSRELPSRPDGVLHVALPTVLTPLAPPGPPGPPRPPGLCDDSPTSCFGVGSLQEEGLAWEELAAPRDVFSGPARCPAPYTFSFEMLVTGPCLLAGLESPSHALRADAPPHASSAATICVTLAEGHHCDRALEILLHPSEPHQPHLMLEGGSLSSAEYEARVRARRDFQRLQRRDSDGDRQVWFLQRRFHKDILLNPVLALSFCPDLSSKPGHLGTATRELLFLLDSSSVAHKDAIVLAVKSLPPQTLINLAVFGTLVQPLFPESRPCSDDAVQLICESIETLQVPSGPPDVLAALDWAVGQPQHRAYPRQLFLLTAASPMAATTHRTLELMRWHRGTARCFSFGLGPTCHQLLQGLSALSRGQAYFLRPGQRLQPMLVQALRKALEPALSDISVDWFVPDTVEALLTPREIPALYPGDQLLGYCSLFRVDGFRSRPPGGQEPGWQSSGGSVFPSPEEAPSAASPGTEPTGTSEPLGTGTVSAELSSPWAARDSEQSTDALTDPVTDPGPNPSDTAIWRRIFQSSYIREQYVLTHCSASPEPGPGSTGSSESPGSQGPGSPEGSAPLEPPSQQGCRSLAWGEPAGSRSCPLPAPTPAPFKVGALSTEVLGRQHRAALAGRSLSSPPGRANQVPGRPRKPSLGAILDGPSPEPGQQLGQGLDDSGNLLSPAPMDWDMLMEPPFLFTAVPPSGELAPPAVPPQAPRCHVVIRGLCGEQPMCWEVGVGLETLWGPGDGSQPPSPPVREAAWDQALHRLTAASVVRDNEQLALRGGAETTADRGHARRCWLRALQTSKVSSAPSCFTCPVAVDATTREVLPGALQVCSSEPAEPPGTPPASHSHLDAAPLPTVVYSKGLQRGSPAGAWDSDQNGNSKRALGDPATPTEGPRRPPPRPPCRLSMGRRHKLCSPDPGQANNSEGSDHDYLPLVRLQEAPGSFRLDAPFCAAVRISQERLCRASPFAVHRASLSPTSASLPWALLGPGVGQGDSATASCSPSPSSGSEGPGQVDSGRGSDTEASEGAEGLGGTDLRGRTWATAVALAWLEHRCAAAFDEWELTAAKADCWLRAQHLPDGLDLAALKAAARGLFLLLRHWDQNLQLHLLCYSPANV

SEQ ID NO: 14179 - protein, 891 aa, Homo Sapiens
MLPTEVPQSHPGPSALLLLQLLLPPTSAFFPNIWSLLAAPGSITHQDLTEEAALNVTLQLFLEQPPPGRPPLRLEDFLGRTLLADDLFAAYFGPGSSRRFRAALGEVSRANAAQDFLPTSRNDPDLHFDAERLGQGRARLVGALRETVVAARALDHTLARQRLGAALHALQDFYSHSNWVELGEQQPHPHLLWPRQELQNLAQVADPTCSDCEELSCPRNWLGFTLLTSGYFGTHPPKPPGKCSHGGHFDRSSSQPPRGGINKDSTSPGFSPHHMLHLQAAKLALLASIQAFSLLRSRLGDRDFSRLLDITPASSLSFVLDTTGSMGEEINAAKIQARHLVEQRRGSPMEPVHYVLVPFHDPGFGPVFTTSDPDSFWQQLNEIHALGGGDEPEMCLSALQLALLHTPPLSDIFVFTDASPKDAFLTNQVESLTQERRCRVTFLVTEDTSRVQGRARREILSPLRFEPYKAVALASGGEVIFTKDQHIRDVAAIVGESMAALVTLPLDPPVVVPGQPLVFSVDGLLQKITVRIHGDISSFWIKNPAGVSQGQEEGGGPLGHTRRFGQFWMVTMDDPPQTGTWEIQVTAEDTPGVRVQAQTSLDFLFHFGIPMEDGPHPGLYPLTQPVAGLQTQLLVEVTGLGSRANPGDPQPHFSHVILRGVPEGAELGQVPLEPVGPPERGLLAASLSPTLLSTPRPFSLELIGQDAAGRRLHRAAPQPSTVVPVLLELSGPSGFLAPGSKVPLSLRIASFSGPQDLDLRTFVNPSFSLTSNLSRAHLELNESAWGRLWLEVPDSAAPDSVVMVTVTAGGREANPVPPTHAFLRLLVSAPAPQDRHTTPTGSSDPILTTATPAFSPFTLVTQGRAGAGLAAGSPWWGTVGGVLLLLGLASW

SEQ ID NO: 14180 - protein, 325 aa, Homo Sapiens
MPSSTAMAVGALSSSLLVTCCLMVALCSPSIPLEKLAQAPEQPGQEKREHASRDGPGRVNELGRPARDEGGSGRDWKSKSGRGLAGREPWSKLKQAWVSQGGGAKAGDLQVRPRGDTPQAEALAAAAQDAIGPELAPTPEPPEEYVYPDYRGKGCVDESGFVYAIGEKFAPGPSACPCLCTEEGPLCAQPECPRLHPRCIHVDTSQCCPQCKERKNYCEFRGKTYQTLEEFVVSPCERCRCEANGEVLCTVSACPQTECVDPVYEPDQCCPICKNGPNCFAETAVIPAGREVKTDECTICHCTYEEGTWRIERQAMCTRHECRQM

SEQ ID NO: 14181 - protein, 222 aa, Homo Sapiens
MALHIHEACILLLVIPGLVTSAAISHEDYPADEGDQISSNDNLIFDDYRGKGCVDDSGFVYKLGERFFPGHSNCPCVCALDGPVCDQPECPKIHPKCTKVEHNGCCPECKEVKNFCEYHGKNYKILEEFKPSPCEWCRCEPSNEVHCVVADCAVPECVNPVYEPEQCCPVCKNGPNCFAGTTIIPAGIEVKVDECNICHCHNGDWWKPAQCSKRECQGKQTV

SEQ ID NO: 14182 - protein, 139 aa, Homo Sapiens
MALHIHEACILLLVIPGLVTSAAISHEDYPADEGDQISSNDNLIFDDYRGKGCVDDSGFVYKLGERFFPGHSNCPCVCALDGPVCDQPECPKIHPKCTKVEHNGCCPECKEVKNFCEYHGKNYKILEEFKVQTALQERR

SEQ ID NO: 14183 - protein, 670 aa, Homo Sapiens [sequence omitted]

SEQ ID NO: 14184 - protein, 420 aa, Homo Sapiens
MPCPELACPREEWRLGPGQCCFTCQEPTPSTGCSLDDNGVEFPIGQIWSPGDPCELCICQADGSVSCKRTDCVDSCPHPIRIPGQCCPDCSAGCTYTGRIFYNNETFPSVLDPCLSCICLLGSVACSPVDCPITCTYPFHPDGECCPVCRDCNYEGRKVANGQVFTLDDEPCTRCTCQLGEVSCEKVPCQRACADPALLPGDCCSSCPDSLSPLEEKQGLSPHGNVAFSKAGRSLHGDTEAPVNCSSCPGPPTASPSRPVLHLLQLLLRTNLMKTQTLPTSPAGAHGPHSLALGLTATFPGEPGASPRLSPGPSTPPGAPTLPLASPGAPQPPPVTPERSFSASGAQIVSRWPPLPGTLLTEASALSMMDPSPSKTPITLLGPRVLSPTTSRLSTALAATTHPGPQQPPVGASRGEESTM

SEQ ID NO: 14185 - protein, 219 aa, Homo Sapiens
MWAGLLLRAACVALLLPGAPARGYTGRKPPGHFAAERRRLGPHVCLSGFGSGCCPGWAPSMGGGHCTLPLCSFGCGSGICIAPNVCSCQDGEQGATCPETHGPCGEYGCDLTCNHGGCQEVARVCPVGFSMTETAVGIRCTDIDECVTSSCEGHCVNTEGGFVCECGPGMQLSADRHSCQDTDECLGTPCQQRCKNSIGSYKCSCRTGFHLHGNRHSCM

SEQ ID NO: 14186 - protein, 955 aa, Homo Sapiens
MWAGLLLRAACVALLLPGAPARGYTGRKPPGHFAAERRRLGPHVCLSGFGSGCCPGWAPSMGGGHCTLPLCSFGCGSGICIAPNVCSCQDGEQGATCPETHGPCGEYGCDLTCNHGGCQEVARVCPVGFSMTETAVGIRCTDIDECVTSSCEGHCVNTEGGFVCECGPGMQLSADRHSCQDTDECLGTPCQQRCKNSIGSYKCSCRTGFHLHGNRHSCVDVNECRRPLERRVCHHSCHNTVGSFLCTCRPGFRLRADRVSCEAFPKAVLAPSAILQPRQHPSKMLLLLPEAGRPALSPGHSPPSGAPGPPAGVRTTRLPSPTPRLPTSSPSAPVWLLSTLLATPVPTASLLGNLRPPSLLQGEVMGTPSSPRGPESPRLAAGPSPCWHLGAMHESRSRWTEPGCSQCWCEDGKVTCEKVRCEAACSHPIPSRDGGCCPSCTGCFHSGVVRAEGDVFSPPNENCTVCVCLAGNVSCISPECPSGPCQTPPQTDCCTCVPVRCYFHGRWYADGAVFSGGGDECTTCVCQNGEVECSFMPCPELACPREEWRLGPGQCCFTCQEPTPSTGCSLDDNGVEFPIGQIWSPGDPCELCICQADGSVSCKRTDCVDSCPHPIRIPGQCCPDCSAGCTYTGRIFYNNETFPSVLDPCLSCICLLGSVACSPVDCPITCTYPFHPDGECCPVCRDCNYEGRKVANGQVFTLDDEPCTRCTCQLGEVSCEKVPCQRACADPALLPGDCCSSCPDSLSPLEEKQGLSPHGNVAFSKAGRSLHGDTEAPVNCSSCPGPPTASPSRPVLHLLQLLLRTNLMKTQTLPTSPAGAHGPHSLALGLTATFPGEPGASPRLSPGPSTPPGAPTLPLASPGAPQPPPVTPERSFSASGAQIVSRWPPLPGTLLTEASALSMMDPSPSKTPITLLGPRVLSPTTSRLSTALAATTHPGPQQPPVGASRGEESTM

SEQ ID NO: 14187 - protein, 173 aa, Homo Sapiens
MWAGLLLRAACVALLLPGAPARGYTGRKPPGHFAAERRRLGPHVCLSGFGSGCCPGWAPSMGGGHCTLRKCLSLCPKSSPPAVCVASPQSLVRGADGRPQFLVSHLHFSSQPSAPSAVGVASASLPMSAPARMESKGPPAQKPMDHVGSTAVTLPATMEAVRRWPECAPWASR

SEQ ID NO: 14188 - protein, 1590 aa, Homo Sapiens
MPGGACVLVIALMFLAWGEAQECSPGGHQFLRSPYRSVRFDSWHLQQSAVQDLICDHSLSPGWYRFLILDRPAEMPTKCVEMNHCGTQAPIWLSLRDSETLPSPGEIKQLTACATWQFLFSTTKDCCLFQIPVSVRNCGNFSVYLLQPTQGCMGYCAEAISDARLHPCGSDETETGGDCVRQLAASLPPPPAGRPEVLVELIESRLFCRCSFDVPATKNSVGFHIAWSRLSSQEVKEELTQETTVQAFSLLELDGINLRLGDRIFCSASVFFLENPHVQSVAIESQEFFAGFKLQPELSTISEDGKEYYLRIESTVPIICSEFSELDQECKISLKLKTIGQGREHLGLNLALSSCHVDLLQTSSCANGTCSHTFVYYTAVTDFSRDGDRVSNIVVQPIVNEDFLWNNYIPDSIQIKVKDVPTAYCYTFTDPHIITFDGRVYDNFKTGTFVLYKSMSRDFEVHVRQWDCRSLHYPVSCNCGFVAQEGGDIVTFDMCNGQLRESQPYLFIKSQDVTRNIKISESYLGRKVTIWFSSGAFIRADLGEWGMSLTIRAPSVDYRNTLGLCGTFDENPENDFHDKNGMQIDQNFNNYVAFINEWRILPGKSMSDTLPVSMTSPGKPSYCSCSLDTAAYPSSEDLDSVSRSEIALGCKDLNHVSLSSLIPELDVTSEYINSDTLVREINKHTSPEEYNLNLFLQEKKHINLTKLGLNVQKHPGNEKEDSLQYLANKKYTQGRGSHSQEMRYNRQNRWKRQNFHEFPPLFAFPSLSQTDLEELTYFFPEDHAEDVQQEFFPSWPTPSGLTEYSTLTLCQETLANSSIGRLCLAFLGKRLDSVIEMCVKDVLLKDDLSWAEAGVALLENECEKRIVEEGKYNTEEYGTSIEDILSVLKCPNLCSGNGQCMEWGCACSPSFSSYDCSDSYDKAPEITELGNAGFCDVQKYNCMMVRVFGKGFKELPSIKCEVTKLQYNSSEWMPGEPIYTQTVFHNSRAVDCQLPTDVQQFDTMDLVGGKPTGKWQLKVSNDGYKFSNPKITVIYDGACQVCGLYKNDSCTIKENVCIIDGLCYVEGDKNPTSPCLICRPKISRFTWSFLENNQPPVIQALQDKLQTFYGENFEYQFVAFDPEGSDIHFTLDSGPEGASVSSAGLFMWKTDLLTTQQITVRLNDDCDAETRVTIEVTVKSCDCLNGGSCVSDRNFSPGSGVYLCVCLPGFHGSLCEVDISGCQSNPCGLGSYISGFHSYSCDCPPELKVETQFVNQFTTQTVVLTRSDKSVNKEEDDKNAQGRKRHVKPTSGNAFTICKYPCGKSRECVAPNICKCKPGYIGSNCQTALCDPDCKNHGKCIKPNICQCLPGHGGATCDEEHCNPPCQHGGTCLAGNLCTCPYGFVGPRCETMVCNRHCENGGQCLTPDICQCKPGWYGPTCSTALCDPVCLNGGSCNKPNTCLCPNGFFGEHCQNAFCHPPCKNGGHCMRNNVCVCREGYTGRRFQKSICDPTCMNGGKCVGPSTCSCPSGWSGKRCNTPICLQKCKNGGECIAPSICHCPSSWEGVRCQIPICNPKCLYGGRCIFPNVCSCRTEYSGVKCEKKIQIRRH

SEQ ID NO: 14189 - protein, 1302 aa, Homo Sapiens
MPGGACVLVIALMFLAWGEAQECSPGGHQFLRSPYRSVRFDSWHLQQSAVQDLICDHSLSPGWYRFLILDRPAEMPTKCVEMNHCGTQAPIWLSLRDSETLPSPGEIKQLTACATWQFLFSTTKDCCLFQIPVSVRNCGNFSVYLLQPTQGCMGYCAEAISDARLHPCGSDETETGGDCVRQLAASLPPPPAGRPEVLVELIESRLFCRCSFDVPATKNSVGFHIAWSRLSSQEVKEELTQETTVQAFSLLELDGINLRLGDRIFCSASVFFLENPHVQSVAIESQEFFAGFKLQPELSTISEDGKEYYLRIESTVPIICSEFSELDQECKISLKLKTIGQGREHLGLNLALSSCHVDLLQTSSCANGTCSHTFVYYTAVTDFSRDGDRVSNIVVQPIVNEDFLWNNYIPDSIQIKVKDVPTAYCYTFTDPHIITFDGRVYDNFKTGTFVLYKSMSRDFEVHVRQWDCRSLHYPVSCNCGFVAQEGGDIVTFDMCNGQLRESQPYLFIKSQDVTRNIKISESYLGRKVTIWFSSGAFIRADLGEWGMSLTIRAPSVDYRNTLGLCGTFDENPENDFHDKNGMQIDQNFNNYVAFINEWRILPGKSMSDTLPVSMTSPGKPSYCSCSLDTAAYPSSEDLDSVSRSEIALGCKDLNHVSLSSLIPELDVTSEYINSDTLVREINKHTSPEEYNLNLFLQEKKHINLTKLGLNVQKHPGNEKEDSLQYLANKKYTQGRGSHSQEMRYNRQNRWKRQNFHEFPPLFAFPSLSQTDLEELTYFFPEDHAEDVQQEFFPSWPTPSGLTEYSTLTLCQETLANSSIGRLCLAFLGKRLDSVIEMCVKDVLLKDDLSWAEAGVALLENECEKRIVEEGKYNTEEYGTSIEDILSVLKCPNLCSGNGQCMEWGCACSPSFSSYDCSDSYDKAPEITELGNAGFCDVQKYNCMMVRVFGKGFKELPSIKCEVTKLQYNSSEWMPGEPIYTQTVFHNSRAVDCQLPTDVQQFDTMDLVGGKPTGKWQLKVSNDGYKFSNPKITVIYDGACQVCGLYKNDSCTIKENVCIIDGLCYVEGDKNPTSPCLICRPKISRFTWSFLENNQPPVIQALQDKLQTFYGENFEYQFVAFDPEGSDIHFTLDSGPEGASVSSAGLFMWKTDLLTTQQITVRLNDDCDAETRVTIEVTVKSCDCLNGGSCVSDRNFSPGSGVYLCVCLPGFHGSLCEVDISGCQSNPCGLGSYISGFHSYSCDCPPELKGKNCQEDVDECDSKPCFEGVACLNTFGSYHCGSCPEGFYGDGKICHGKSFYFLL

SEQ ID NO: 14190 - protein, 352 aa, Homo Sapiens
MPGGACVLVIALMFLAWGEAQECSPGGHQFLRSPYRSVRFDSWHLQQSAVQDLICDHSLSPGWYRFLILDRPAEMPTKCVEMNHCGTQAPIWLSLRDSETLPSPGEIKQLTACATWQFLFSTTKDCCLFQIPVSVRNCGNFSVYLLQPTQGCMGYCAEAISDARLHPCGSDETETGGDCVRQLAASLPPPPAGRPEVLVELIESRLFCRCSFDVPATKNSVGFHIAWSRLSSQEVKEELTQETTVQAFSLLELDGINLRLGDRIFCSASVFFLENPHVQSVAIESQEFFAGFKLQPELSTISEDGKEYYLRIESTVPIICSEFSELDQECKISLKLKTIGQDLVFFWGIYPC

SEQ ID NO: 14191 - protein, 170 aa, Homo Sapiens
MPGGACVLVIALMFLAWGEAQECSPGGHQFLRSPYRSVRFDSWHLQQSAVQDLICDHSLSPGWYRFLILDRPAEMPTKCVEMNHCGTQAPIWLSLRDSETLPSPGEIKQLTACATWQFLFSTTKDCCLFQIPVSVRNCGNFSVYLLQPTQGCMGYCAEGFFAKIVKSPHT

SEQ ID NO: 14192 - protein, 944 aa, Homo Sapiens
MSLTIRAPSVDYRNTLGLCGTFDENPENDFHDKNGMQIDQNFNNYVAFINEWRILPGKSMSDTLPVSMTSPGKPSYCSCSLDTAAYPSSEDLDSVSRSEIALGCKDLNHVSLSSLIPELDVTSEYINSDTLVREINKHTSPEEYNLNLFLQEKKHINLTKLGLNVQKHPGNEKEDSLQYLANKKYTQGRGSHSQEMRYNRQNRWKRQNFHEFPPLFAFPSLSQTDLEELTYFFPEDHAEDVQQEFFPSWPTPSGLTEYSTLTLCQETLANSSIGRLCLAFLGKRLDSVIEMCVKDVLLKDDLSWAEAGVALLENECEKRIVEEGKYNTEEYGTSIEDILSVLKCPNLCSGNGQCMEWGCACSPSFSSYDCSDSYDKAPEITELGNAGFCDVQKYNCMMVRVFGKGFKELPSIKCEVTKLQYNSSEWMPGEPIYTQTVFHNSRAVDCQLPTDVQQFDTMDLVGGKPTGKWQLKVSNDGYKFSNPKITVIYDGACQVCGLYKNDSCTIKENVCIIDGLCYVEGDKNPTSPCLICRPKISRFTWSFLENNQPPVIQALQDKLQTFYGENFEYQFVAFDPEGSDIHFTLDSGPEGASVSSAGLFMWKTDLLTTQQITVRLNDDCDAETRVTIEVTVKSCDCLNGGSCVSDRNFSPGSGVYLCVCLPGFHGSLCEVDISGCQSNPCGLGSYISGFHSYSCDCPPELKVETQFVNQFTTQTVVLTRSDKSVNKEEDDKNAQGRKRHVKPTSGNAFTICKYPCGKSRECVAPNICKCKPGYIGSNCQTALCDPDCKNHGKCIKPNICQCLPGHGGATCDEEHCNPPCQHGGTCLAGNLCTCPYGFVGPRCETMVCNRHCENGGQCLTPDICQCKPGWYGPTCSTALCDPVCLNGGSCNKPNTCLCPNGFFGEHCQNAFCHPPCKNGGHCMRNNVCVCREGYTGRRFQKRHL

SEQ ID NO: 14193 - protein, 166 aa, Homo Sapiens
VTVKSCDCLNGGSCVSDRNFSPGSGVYLCVCLPGFHGSLCEVDISGCQSNPCGLGSYISGFHSYSCDCPPELKGKNCQEDVDECDSKPCFEGVACLNTFGSYHCGSCPEGFYGDGKICHVETQFVNQFTTQTVVLTRSDKSVNKEEDDKNAQGRKRHVKPTSGNAF

SEQ ID NO: 14194 - protein, 60 aa, Homo Sapiens
MIPARFAGVLLALALILPETRCLQMPSPVGELRSIKVAQNCPILWGHRMRRKESKTWMDY

SEQ ID NO: 14195 - protein, 60 aa, Homo Sapiens; identical to SEQ ID NO: 14194

SEQ ID NO: 14196 - protein, 2813 aa, Homo Sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCQDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRITLLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 14197 - protein, 287 aa, Homo Sapiens
MPALCLVLCWFQGLLGEVWNAVDSGHCLQTYSLHTEAVRAARWAPCGRRILSGGFDFALHLTDLETGTQLFSGRSDFRITTLKFHPKDHNIFLCGGFSSEMKAWDIRTGKVMRSYKATIQQTLDILFLREGSEFLSSTDASTRDSADRTIIAWDFRTSAKISNQIFHERFTCPSLALHPREPVFLAQTNGNYLALFSTVWPYRMSRRRRYEGHKVEGYSVGCECSPGGDLLVTGSADGRVLMYSFRTASRACTLQGHTQACVGTTYHPVLPSVLATCSWGGDMKIWH

SEQ ID NO: 14198 - protein, 544 aa, Homo Sapiens
MTARTLSLMASLVAYDDSDSEAETEHAGSFNATGQQKDTSGVARPPGQDFASGTLDVPKAGAQPTKHGSCEDPGGYRLPLAQLGRSDWGSCPSQRLQWPGKEPQVTFPIKEPSCSSLWTSHVPASHMPLAAARFKQVKLSRNFPKSSFHAQSESETVGKNGSSFQKKKCEDCVVPYTPRRLRQRQALSTETGKGKDVEPQGPPAGRAPAPLYVGPGVSEFIQPYLNSHYKETTVPRKVLFHLRGHRGPVNTIQWCPVLSKSHMLLSTSMDKTFKVWNAVDSGHCLQTYSLHTEAVRAARWAPCGRRILSGGFDFALHLTDLETGTQLFSGRSDFRITTLKFHPKDHNIFLCGGFSSEMKAWDIRTGKVMRSYKATIQQTLDILFLREGSEFLSSTDASTRDSADRTIIAWDFRTSAKISNQIFHERFTCPSLALHPREPVFLAQTNGNYLALFSTVWPYRMSRRRRYEGHKVEGYSVGCECSPGGDLLVTGSADGRVLMYSFRTASRACTLQGHTQACVGTTYHPVLPSVLATCSWGGDMKIWH

SEQ ID NO: 14199 - protein, 544 aa, Homo Sapiens; identical to SEQ ID NO: 14198

SEQ ID NO: 14200 - protein, 274 aa, Homo Sapiens
MTARTLSLMASLVAYDDSDSEAETEHAGSFNATGQQKDTSGVARPPGQDFASGTLDVPKAGAQPTKHGSCEDPGGYRLPLAQLGRSDWGSCPSQRLQWPGKEPQVTFPIKEPSCSSLWTSHVPASHMPLAAARFKQVKLSRNFPKSSFHAQSESETVGKNGSSFQKKKCEDCVVPYTPRRLRQRQALSTETGKGKDVEPQGPPAGRAPAPLYVGPGVSEFIQPYLNSHYKETTVPRKVLFHLRGHRGPVNTIQWCPVLSKSHMLLSTSMDKTFK

SEQ ID NO: 14201 - protein, 289 aa, Homo Sapiens
MTARTLSLMASLVAYDDSDSEAETEHAGSFNATGQQKDTSGVARPPGQDFASGTLDVPKAGAQPTKHGSCEDPGGYRLPLAQLGRSDWGSCPSQRLQWPGKEPQVTFPIKEPSCSSLWTSHVPASHMPLAAARFKQVKLSRNFPKSSFHAQSESETVGKNGSSFQKKKCEDCVVPYTPRRLRQRQALSTETGKGKDVEPQGPPAGRAPAPLYVGPGVSEFIQPYLNSHYKETTVPRKVLFHLRGHRGPVNTIQWCPVLSKSHMLLSTSMDKTFKEPSYLVVEVTLESLP

SEQ ID NO: 14202 - protein, 544 aa, Homo Sapiens; identical to SEQ ID NO: 14198

SEQ ID NO: 14203 - protein, 121 aa, Homo Sapiens
  misc_feature (1)..(1): Xaa can be any naturally occurring amino acid
XSTDASTRDSADRTIIAWDFRTSAKISNQIFHERFTCPSLALHPREPVFLAQTNGNYLALFSTVWPYRMSRRRRYEGHKVLLSLSPRRMLSPSPKPPGSPGHGPWGAWSLCLGGSCFLFPG

SEQ ID NO: 14204 - protein, 1941 aa, Homo Sapiens
MAQGSGGREGALRTPAGGWHSPPSPDMQELLRSVERDLSIDPRQLAPAPGGTHVVALVPARWLASLRDRRLPLGPCPRAEGLGEAEVRTLLQRSVQRLPAGWTRVEVHGLRKRRLSYPLGGGLPFEDGSCGPETLTRFMQEVAAQNYRNLWRHAYHTYGQPYSHSPAPSAVPALDSVRQALQRVYGCSFLPVGETTQCPSYAREGPCPPRGSPACPSLLRAEALLESPEMLYVVHPYVQFSLHDVVTFSPAKLTNSQAKVLFILFRVLRAMDACHRQGLACGALSLYHIAVDEKLCSELRLDLSAYERPEEDENEEAPVARDEAGIVSQEEQGGQPGQPTGQEELRSLVLDWVHGRISNFHYLMQLNRLAGRRQGDPNYHPVLPWVVDFTTPHGRFRDLRKSKFRLNKGDKQLDFTYEMTRQAFVAGGAGGGEPPHVPHHISDVLSDITYYVYKARRTPRSVLCGHVRAQWEPHEYPASMERMQNWTPDECIPEFYTDPSIFRSIHPDMPDLDVPAWCSSSQEFVAAHRALLESREVSRDLHHWIDLTFGYKLQGKEAVKEKNVCLHLVDAHTHLASYGVVQLFDQPHPQRLAGAPALAPEPPLIPKLLVQTIQETTGREDFTENPGQLPNGVGRPVLEATPCEASWTRDRPVAGEDDLEQATEALDSISLAGKAGDQLGSSSQASPGLLSFSVASASRPGRRNKAAGADPGEGEEGRILLPEGFNPMQALEELEKTGNFLAKGLGGLLEVPEQPRVQPAVPLQCLLHRDMQALGVLLAEMVFATRVRTLQPDAPLWVRFQAVRGLCTRHPKEVPVSLQPVLDTLLQMSGPEVPMGAERGKLDQLFEYRPVSQGLPPPCPSQLLSPFSSVVPFPPYFPALHRFILLYQARRVEDEAQGRELVFALWQQLGAVLKDITPEGLEILLPFVLSLMSEEHTAVYTAWYLFEPVAKALGPKNANKYLLKPLIGAYESPCQLHGRFYLYTDCFVAQLMVRLGLQAFLTHLLPHVLQVLAGAEASQEESKDLAGAAEEEESGLPGAGPGSCAFGEEIPMDGEPPASSGLGLPDYTSGVSFHDQADLPETEDFQAGLYVTESPQPQEAEAVSLGRLSDKSSTSETSLGEERAPDEGGAPVDKSSLRSGDSSQDLKQSEGSEEEEEEEDSCVVLEEEEGEQEEVTGASELTLSDTVLSMETVVAGGSGGDGEEEEEALPEQSEGKEQKILLDTACKMVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 14205 - protein, 890 aa, Homo Sapiens
MDGEPPASSGLGLPDYTSGVSFHDQADLPETEDFQAGLYVTESPQPQEAEAVSLGRLSDKSSTSETSLGEERAPDEGGAPVDKSSLRSGDSSQDLKQSEGSEEEEEEEDSCVVLEEEEGEQEEVTGASELTLSDTVLSMETVVAGGSGGDGEEEEEALPEQSEGKEQKILLDTACKMVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 14206 - protein, 580 aa, Homo Sapiens
MDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 14207 - protein, 171 aa, Homo Sapiens
MHAGPCSSQPDTVVPRTQRALFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMP

SEQ ID NO: 14208 - protein, 172 aa, Homo Sapiens
MLVRVVLSLTPSFPEPSALYTACKMVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLP

SEQ ID NO: 14209 - protein, 738 aa, Homo Sapiens
MLVRVVLSLTPSFPEPSALYTACKMVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 14210 - protein, 132 aa, Homo Sapiens
MVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGG

SEQ ID NO: 14211 - protein, 714 aa, Homo Sapiens
MVRWLSAKLGPTVASRHVARNLLRLLTSCYVGPTRQQFTVSSGESPPLSAGNIYQKRPVLGDIVSGPVLSCLLHIARLYGEPVLTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASSDSTLRFVDCRKPGLQHEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 14212 - protein, 197 aa, Homo Sapiens
  misc_feature (1)..(1): Xaa can be any naturally occurring amino acid
XFQAGLYVTESPQPQEAEAVSLGRLSDKSSTSETSLGEERAPDEGGAPVDKSSLRSGDSSQDLKQSEGSEEEEEEEDSCVVLEEEEGEQEEVTGASELTLSDTVLSMETVVAGGSGGDGEEEEEALPEQSEGKEQKILLGPTRQQFTVSSGESPPLSAGNIYQKRPVLGDIVSGPVLSCLLHIARLYGEPVLTYQYL

SEQ ID NO: 14213 - protein, 123 aa, Homo Sapiens
  misc_feature (1)..(1): Xaa can be any naturally occurring amino acid
XRLLTSCYVGPTRQQFTVSSGESPPLSAGNIYQKRPVLGDIVSGPVLSCLLHIARLYGEPVLTYQYLPYISYLVPKWGPGSDHPVCENHQPHRPHLPAHWTGDGPAAPERARGHLFPGLLSAA

SEQ ID NO: 14214 - protein, 475 aa, Homo Sapiens
ARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGHLPASRQRWVAASEGCRRLQREWAGQHGLEAGHRLLCLHVRPPGGGGGPALWRPAALVRPLCGDLHAGPQPQCPGPGLCLGPKQHDRPLSDPRLGRVWRPLPASHFPP

SEQ ID NO: 14215 - protein, 115 aa, Homo Sapiens
EKIPLPFFAMSLSLSPGTHLLAVGFAGLHRPPGCSSRPPATRSLCGRSPASEMQQGLWWWASRLVMPGTWTQAWQRRQVVNGLMLGQARIHVNRLEQAVVNLAPCEYFHTCCPFA

SEQ ID NO: 14216 - protein, 1748 aa, Homo Sapiens
MARAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPLPCPVASSKPVRFSVSPVVQTPSPTASGRAALAPRPFPEVSLSQERSDASNADGPGFHSLEPWAQLEASDIHTAAAGTHVLTHESAEVPVARTGSCEGFLPDPVLRLKGVIGFGGHGTRQALWTPDGAAVVYPCHAVIVVLLVDTGEQRFFLGHTDKVSALALDGSSSLLASAQARAPSVMRLWDFQTGRCLCLFRSPMHVVCSLSFSDSGALLCGVGKDHHGRTMVVAWGTGQVGLGGEVVVLAKAHTDFDVQAFRVTFFDETRMASCGQGSVRLWRLRGGVLRSCPVDLGEHHALQFTDLAFKQARDGCPEPSAAMLFVCSRSGHILEIDCQRMVVRHARRLLPTRTPGGPHPQKQTFSSGPGIAISSLSVSPAMCAVGSEDGFLRLWPLDFSSVLLEAEHEGPVSSVCVSPDGLRVLSATSSGHLGFLDTLSRVYHMLARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGARDTRNSGAPRTTYLASCKAFTPARVSCSPHSAKGTCPPPASGGWLRLKAVVGYSGNGRANMVWRPDTGFFAYTCGRLVVVEDLHSGAQQHWSGHSAEISTLALSHSAQVLASASGRSSTTAHCQIRVWDVSGGLCQHLIFPHSTTVLALAFSPDDRLLVTLGDHDGRTLALWGTATYDLVSSTRLPEPVHGVAFNPWDAGELTCVGQGTVTFWLLQQRGADISLQVRREPVPEAVGAGELTSLCYGAPPLLYCGTSSGQVCVWDTRAGRCFLSWEADDGGIGLLLFSGSRLVSGSSTGRLRLWAVGAVSELRCKGSGASSVFMEHELVLDGAVVSASFDDSVDMGVVGTTAGTLWFVSWAEGTSTRLISGHRSKVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKECEDLGVEGTDLWLAASGDQRVSVWASDWLRNHCELVDWLSFPMPATTETQGHLPPSLAAFCPWDGALLMYVGPGVYKEVIIYNLCQKQVVEKIPLPFFAMSLSLSPGTHLLAVGFAECMLRLVDCAMGTAQDFAGHDNAVHLCRFTPSARLLFTAARNEILVWEVPGL

SEQ ID NO: 14217 - protein, 1750 aa, Homo Sapiens
MARAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPLPCPVASSKPVRFSVSPVVQTPSPTASGRAALAPRPFPEVSLSQERSDASNADGPGFHSLEPWAQLEASDIHTAAAGTHVLTHESAEVPVARTGSCEGFLPDPVLRLKGVIGFGGHGTRQALWTPDGAAVVYPCHAVIVVLLVDTGEQRFFLGHTDKVSALALDGSSSLLASAQARAPSVMRLWDFQTGRCLCLFRSPMHVVCSLSFSDSGALLCGVGKDHHGRTMVVAWGTGQVGLGGEVVVLAKAHTDFDVQAFRVTFFDETRMASCGQGSVRLWRLRGGVLRSCPVDLGEHHALQFTDLAFKQARDGCPEPSAAMLFVCSRSGHILEIDCQRMVVRHARRLLPTRTPGGPHPQKQTFSSGPGIAISSLSVSPAMCAVGSEDGFLRLWPLDFSSVLLEAEHEGPVSSVCVSPDGLRVLSATSSGHLGFLDTLSRVYHMLARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGARDTRNSGAPRTTYLASCKAFTPARVSCSPHSAKGTCPPPASGGWLRLKAVVGYSGNGRANMVWRPDTGFFAYTCGRLVVVEDLHSGAQQHWSGHSAEISTLALSHSAQVLASASGRSSTTAHCQIRVWDVSGGLCQHLIFPHSTTVLALAFSPDDRLLVTLGDHDGRTLALWGTATYDLVSSTRLPEPVHGVAFNPWDAGELTCVGQGTVTFWLLQQRGADISLQVRREPVPEAVGAGELTSLCYGAPPLLYCGTSSGQVCVWDTRAGRCFLSWEADDGGIGLLLFSGSRLVSGSSTGRLRLWAVGAVSELRCKGSGARSSSVFMEHELVLDGAVVSASFDDSVDMGVVGTTAGTLWFVSWAEGTSTRLISGHRSKVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKECEDLGVEGTDLWLAASGDQRVSVWASDWLRNHCELVDWLSFPMPATTETQGHLPPSLAAFCPWDGALLMYVGPGVYKEVIIYNLCQKQVVEKIPLPFFAMSLSLSPGTHLLAVGFAECMLRLVDCAMGTAQDFAGHDNAVHLCRFTPSARLLFTAARNEILVWEVPGL

SEQ ID NO: 14218 - protein, 347 aa, Homo Sapiens
MLWFGQPGPGGWNRKCLRPFTLPRGQHPQPSYGFPQVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKECEDLGVEGTDLWLAASGDQRVSVWASDWLRNHCELVDWLSFPMPATTETQGHLPPSLAAFCPWDGALLMYVGPGVYKEVIIYNLCQKQVVEKIPLPFFAMSLSLSPGTHLLAVGFAECMLRLVDCAMGTAQDFAGHDNAVHLCRFTPSARLLFTAARNEILVWEVPGL

SEQ ID NO: 14219 - protein, 299 aa, Homo Sapiens
MLWFGQPGPGGWNRKCLRPFTLPRGQHPQPSYGFPQVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKETQGHLPPSLAAFCPWDGALLMYVGPGVYKEVIIYNLCQKQVVEKIPLPFFAMSLSLSPGTHLLAVGFAECMLRLVDCAMGTAQDFAGHDNAVHLCRFTPSARLLFTAARNEILVWEVPGL

SEQ ID NO: 14220 - protein, 78 aa, Homo Sapiens
  misc_feature (1)..(1): Xaa can be any naturally occurring amino acid
XASGDQRVSVWASDWLRNHCELVDWLSFPMPATTETQGHLPPSLAAFCPWDGALLMYVGPGVYKEVIIYNLCQKQSAC

SEQ ID NO: 14221 - protein, 133 aa, Homo Sapiens
  misc_feature (1)..(1): Xaa can be any naturally occurring amino acid
XPGAGPLEDAASRASELPRQQVPKPCQASPPRLGVCARPPEGGDGARDTRNSGAPRTTYLASCKAFTPARVSCSPHSAKALGHRWPCWAPAASGSPSSQGTCPPPASGGWLRLKAVVGYSGNGRANMVWRPDT

SEQ ID NO: 14222 - protein, 220 aa, Homo Sapiens
MPLTGVGPGSCRRQIIRALCLLLLLLHAGSAKNIWKRALPARLAEKSRAEEAGAPGGPRQPRADRCPPPPRTLPPGACQAARCQADSECPRHRRCCYNGCAYACLEAVPPPPVLDWLVQPKPRWLGGNGWLLDGPEEVLQAEACSTTEDGAEPLLCPSGYECHILSPGDVAEGIPNRGQCVKQRRQADGRILRHKLYKEYPEGDSKNVAEPGRGQQKHFQ

SEQ ID NO: 14223 - protein, 220 aa, Homo Sapiens; identical to SEQ ID NO: 14222

SEQ ID NO: 14224 - protein, 66 aa, Homo Sapiens
MPLTGVGPGSCRRQIIRALCLLLLLLHAGSAKNIWKRALPARLAEKSRVSAWDGEAGAACVGGSQP

SEQ ID NO: 14225 - protein, 79 aa, Homo Sapiens
MAPQTLLPVLVLCVLLLQAQGGYRDKKRMQKTQLSPEIKVCQQQPKLYLCKHLCESHRDCQANNICCSTYCGNVCMSIL

SEQ ID NO: 14226 - protein, 73 aa, Homo Sapiens
MAPQTLLLVLVLCVLLLQAQGGYRDKMRMQRIKVCEKRPSIDLCIHHCSYFQKCETNKICCSAFCGNICMSIL

SEQ ID NO: 14227 - protein, 89 aa, Homo Sapiens
MVSCERRASKSVGQILLWDFGYTCRLSHRRRNSTEILSRNLPALYTGIKVCEKRPSIDLCIHHCSYFQKCETNKICCSAFCGNICMSIL

SEQ ID NO: 14228 - protein, 87 aa, Homo Sapiens
MVSLMKLWIPMLMTFFCTVLLSVLGEMRKKRYDRKELLLEECWGKPNVKECTNKCSKAFRCKDKNYTCCWTYCGNICWINVETSGDY

SEQ ID NO: 14229 - protein, 87 aa, Homo Sapiens; identical to SEQ ID NO: 14228

SEQ ID NO: 14230 - protein, 87 aa, Homo Sapiens; identical to SEQ ID NO: 14228

SEQ ID NO: 14231 - protein, 111 aa, Homo Sapiens
MGSSSFLVLMVSLVLVTLVAVEGVKEGIEKAGVCPADNVRCFKSDPPQCHTDQDCLGERKCCYLHCGFKCVIPVKELEEGGNKDEDVSRPYPEPGWEAKCPGSSSTRCPQK

SEQ ID NO: 14232 - protein, 93 aa, Homo Sapiens
MKPVLPLQFLVVFCLALQLVPGSPKQRVLKYILEPPPCISAPENCTHLCTMQEDCEKGFQCCSSFCGIVCSSETFQKRNRIKHKGSEVIMPAN

SEQ ID NO: 14233 - protein, 73 aa, Homo Sapiens
MLQVQVNLPVSPLPTYPYSFFYPDKEGSCPQVNINFPQLGLCRDQCQVDSQCPGQMKCCRNGCGKVSCVTPNF

SEQ ID NO: 14234 - protein, 76 aa, Homo Sapiens
MPACRLGPLAAALLLSLLLFGFTLVSDKEGSCPQVNINFPQLGLCRDQCQVDSQCPGQMKCCRNGCGKVSCVTPNF

SEQ ID NO: 14235 - protein, 102 aa, Homo Sapiens
MPACRLGPLAAALLLSLLLFGFTLVSGTGAEKTGVCPELQADQNCTQECVSDSECADNLKCCSAGCATFCSLPNALFHWHLKTRRLWEISGPRPRRPTWDSS

SEQ ID NO: 14236 - protein, 124 aa, Homo Sapiens
MPACRLGPLAAALLLSLLLFGFTLVSGTGAEKTGVCPELQADQNCTQECVSDSECADNLKCCSAGCATFCSLPNDKEGSCPQVNINFPQLGLCRDQCQVDSQCPGQMKCCRNGCGKVSCVTPNF

SEQ ID NO: 14237 - protein, 79 aa, Homo Sapiens
MPACRLGPLAAALLLSLLLFGFTLVSGTGAEKTGVCPELQADQNCTQECVSDSECADNLKCCSAGCATFCSLPNGQLAE

SEQ ID NO: 14238 - protein, 137 aa, Homo Sapiens
MMLSCLFLLKALLALGSLESWITAGEHAKEGECPPHKNPCKELCQGDELCPAEQKCCTTGCGRICRDIPKGRGGDCPKVLVGLCIVGCVMDENCQAGEKCCKSGCGRFCVPPVLPPKLTMNPNWTVRSDSELEIPVP

SEQ ID NO: 14239 - protein, 231 aa, Homo Sapiens
MMLSCLFLLKALLALGSLESWITAGEHAKEGECPPHKNPCKELCQGDELCPAEQKCCTTGCGRICRDIPKGRKRDCPRVIRKQSCLKRCITDETCPGVKKCCTLGCNKSCVVPISKQKLAEFGGECPADPLPCEELCDGDASCPQGHKCCSTGCGRTCLGDIEGGRGGDCPKVLVGLCIVGCVMDENCQAGEKCCKSGCGRFCVPPVLPPKLTMNPNWTVRSDSELEIPVP

SEQ ID NO: 14240 - protein, 94 aa, Homo Sapiens
MMLSCLFLLKALLALGSLESWITAGEHGRGGDCPKVLVGLCIVGCVMDENCQAGEKCCKSGCGRFCVPPVLPPKLTMNPNWTVRSDSELEIPVP

SEQ ID NO: 14241 - protein, 225 aa, Homo Sapiens
  misc_feature (1)..(1): Xaa can be any naturally occurring amino acid
XIKEALLALGSLESWITAGEHAKEGECPPHKNPCKELCQGDELCPAEQKCCTTGCGRICRDIPKGRKRDCPRVIRKQSCLKRCITDETCPGVKKCCTLGCNKSCVVPISKQKLAEFGGECPADPLPCEELCDGDASCPQGHKCCSTGCGRTCLGDIEGGRGGDCPKVLVGLCIVGCVMDENCQAGEKCCKSGCGRFCVPPVLPPKLTMNPNWTVRSDSELEIPVP

SEQ ID NO: 14242 - protein, 123 aa, Homo Sapiens
MRTQSLLLLGALLAVGSQLPAVFGRKKGEKSGGCPPDDGPCLLSVPDQCVEDSQCPLTRKCCYRACFRQCVPRVSVKLGSCPEDQLRCLSPMNHLCHKDSDCSGKKRCCHSACGRDCRDPARG

SEQ ID NO: 14243 - protein, 224 aa, Homo Sapiens
MRTQSLLLLGALLAVGSQLPAVFGRKKGEKSGGCPPDDGPCLLSVPDQCVEDSQCPLTRKCCYRACFRQCVPRVSVKLGSCPEDQLRCLSPMNHLCHKDSDCSGKKRCCHSACGRDCRDPARGTAPGCPGQANSDLGSVALHLSWGPTERVHDGRPGALPAGQHYLYQRWFQPSDNHWPADTSLQPIHPWFLLLGVKVHSLSSEEGLCITPVLCTTAIRASHPS

SEQ ID NO: 14244 - protein, 131 aa, Homo Sapiens
MGLSGLLPILVPFILLGDIQEPGHAEGILGKPCPKIKVECEVEEIDQCTKPRDCPENMKCCPFSRGKKCLDFRKIYAVCHRRLAPAWPPYHTGGTIKKTKICSEFIYGGSQGNNNNFQTEAICLVTCKKYH

SEQ ID NO: 14245 - protein, 86 aa, Homo Sapiens
MGLSGLLPILVPFILLGDIQEPGHAEGILGKPCPKIKVECEVEEIDQCTKPRDCPENMKCCPFSRGKKCLDFRKVSLTLYHKEELE

SEQ ID NO: 14246 - protein, 241 aa, Homo Sapiens
MWTVRTEGGHFPLHSPTFSWRNVAFLLLLSLALEWTSAMLTKKIKHKPGLCPKERLTCTTELPDSCNTDFDCKEYQKCCFFACQKKCMDPFQEPCMLPVRHGNCNHEAQRWHFDFKNYRCTPFKYRGCEGNANNFLNEDACRTACMLIVKDGQCPLFPFTERKECPPSCHSDIDCPQTDKCCESRCGFVCARAWTVKKGFCPRKPLLCTKIDKPKCLQDEECPLVEKCCSHCGLKCMDPRR

SEQ ID NO: 14247 - protein, 241 aa, Homo Sapiens; identical to SEQ ID NO: 14246

SEQ ID NO: 14248 - protein, 548 aa, Homo Sapiens
MPALRPLLPLLLLLRLTSGAGLLPGLGSHPGVCPNQLSPNLWVDAQSTCERECSRDQDCAAAEKCCINVCGLHSCVAARFPGSPAAPTTAASCEGFVCPQQGSDCDIWDGQPVCRCRDRCEKEPSFTCASDGLTYYNRCYMDAEACLRGLHLHIVPCKHVLSWPPSSPGPPETTARPTPGAAPVPPALYSSPSPQAVQVGGTASLHCDVSGRPPPAVTWEKQSHQRENLIMRPDQMYGNVVVTSIGQLVLYNARPEDAGLYTCTARNAAGLLRADFPLSVVQREPARDAAPSIPAPAECLPDVQACTGPTSPHLVLWHYDPQRGGCMTFPARGCDGAARGFETYEACQQACARGPGDACVLPAVQGPCRGWEPRWAYSPLLQQCHPFVYGGCEGNGNNFHSRESCEDACPVPRTPPCRACRLRSKLALSLCRSDFAIVGRLTEVLEEPEAAGGIARVALEDVLKDDKMGLKFLGTKYLEVTLSGMDWACPCPNMTAGDGPLVIMGEVRDGVAVLDAGSYVRAASEKRVKKILELLEKQACELLNRFQD

SEQ ID NO: 14249 - protein, 483 aa, Homo Sapiens
MDVKGKKGPVGMPKEATCDHFMCLQQGSECDIWDGQPVCKCKDRCEKEPSFTCASDGLTYYNRCYMDAEACSKGITLAVVTCRYHFTWPNTSPPPPETTMHPTTASPETPELDMAAPALLNNPVHQSVTMGETVSFLCDVVGRPRPEITWEKQLEDRENVVMRPNHVRGNVVVTNIAQLVIYNAQLQDAGIYTCTARNVAGVLRADFPLSVVRGHQAAATSESSPNGTAFPAAECLKPPDSEDCGEEQTRWHFDAQANNCLTFTFGHCHRNLNHFETYEACMLACMSGPLAACSLPALQGPCKAYAPRWAYNSQTGQCQSFVYGGCEGNGNNFESREACEESCPFPRGNQRCRACKPRQKLVTSFCRSDFVILGRVSELTEEPDSGRALVTVDEVLKDEKMGLKFLGQEPLEVTLLHVDWACPCPNVTVSEMPLIIMGEVDGGMAMLRPDSFVGASSARRVRKLREVMHKKTCDVLKEFLGLH

SEQ ID NO: 14250 - protein, 576 aa, Homo Sapiens
MWAPRCRRFWSRWEQVAALLLLLLLLGVPPRSLALPPIRYSHAGICPNDMNPNLWVDAQSTCRRECETDQECETYEKCCPNVCGTKSCVAARYMDVKGKKGPVGMPKEATCDHFMCLQQGSECDIWDGQPVCKCKDRCEKEPSFTCASDGLTYYNRCYMDAEACSKGITLAVVTCRYHFTWPNTSPPPPETTMHPTTASPETPELDMAAPALLNNPVHQSVTMGETVSFLCDVVGRPRPEITWEKQLEDRENVVMRPNHVRGNVVVTNIAQLVIYNAQLQDAGIYTCTARNVAGVLRADFPLSVVRGHQAAATSESSPNGTAFPAAECLKPPDSEDCGEEQTRWHFDAQANNCLTFTFGHCHRNLNHFETYEACMLACMSGPLAACSLPALQGPCKAYAPRWAYNSQTGQCQSFVYGGCEGNGNNFESREACEESCPFPRGNQRCRACKPRQKLVTSFCRSDFVILGRVSELTEEPDSGRALVTVDEVLKDEKMGLKFLGQEPLEVTLLHVDWACPCPNVTVSEMPLIIMGEVDGGMAMLRPDSFVGASSARRVRKLREVMHKKTCDVLKEFLGLH

SEQ ID NO: 14251 - protein, 524 aa, Homo Sapiens
MANSAGFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPSSPIYASVSPANPSSKRPLDAHLALVNQHPIGPFPRVQSPPHLKSPSAEATVAGGCLLPPSPSGHPDQTGTNQHFVMVEVHRPDSEPDVNEVRALPQTRTASTLSQLSDSGQTLSEDSGVDAGEAEASAPGRGRQSVSTKSRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 14252 - protein, 556 aa, Homo Sapiens
MHGSLEALLFLPQVTLSLAHAHLICSNAQLEMCVFPHRFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPSSPIYASVSPANPSSKRPLDAHLALVNQHPIGPFPRVQSPPHLKSPSAEATVAGGCLLPPSPSGHPDQTGTNQHFVMVEVHRPDSEPDVNEVRALPQTRTASTLSQLSDSGQTLSEDSGVDAGEAEASAPGRGRQSVSTKSRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 14253 - protein, 345 aa, Homo Sapiens
MNAPLDGLSVSSSSTGSLGSAAGAGGGGGAGLRLLSANVRQLHQALTALLSEAEREQFTHCLNAYHARRNVFDLVRTLRVLLDSPVKRRLLPMLRLVIPRSDQLLFDQYTAEGLYLPATTPYRQPAWGGPDSAGPGEVRLVSLRRAKAHEGLGFSIRGGSEHGVGIYVSLVEPGSLAEKEGLRVGDQILRVNDKSLARVTHAEAVKALKGSKKLVLSVYSAGRIPGGYVTNHIYTWVDPQGRSISPPSGLPQPHGGALRQQEGDRRSTLHLLQGGDEKKVSGVGKGGQPLRHRILPPNPEQQSCLEAARRGWFCPGSVFPQVCTEGWCFFFAFLFDLCSVCYNTG

SEQ ID NO: 14254 - protein, 907 aa, Homo Sapiens
MNAPLDGLSVSSSSTGSLGSAAGAGGGGGAGLRLLSANVRQLHQALTALLSEAEREQFTHCLNAYHARRNVFDLVRTLRVLLDSPVKRRLLPMLRLVIPRSDQLLFDQYTAEGLYLPATTPYRQPAWGGPDSAGPGEVRLVSLRRAKAHEGLGFSIRGGSEHGVGIYVSLVEPGSLAEKEGLRVGDQILRVNDKSLARVTHAEAVKALKGSKKLVLSVYSAGRIPGGYVTNHIYTWVDPQGRSISPPSGLPQPHGGALRQQEGDRRSTLHLLQGGDEKKVNLVLGDGRSLGLTIRGGAEYGLGIYITGVDPGSEAEGSGLKVGDQILEVNGRSFLNILHDEAVRLLKSSRHLILTVKDVGRLPHARTTVDETKWIASSRIRETMANSAGFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPSSPIYASVSPANPSSKRPLDAHLALVNQHPIGPFPRVQSPPHLKSPSAEATVAGGCLLPPSPSGHPDQTGTNQHFVMVEVHRPDSEPDVNEVRALPQTRTASTLSQLSDSGQTLSEDSGVDAGEAEASAPGRGRQSVSTKSRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 14255 - protein, 128 aa, Homo Sapiens
GVNCDKANCSTTCFNGGTCFYPGKCICPPGLEGEQCEISKCPQPCRNGGKCIGKSKSVCEPGCGAHGTCHEPNKCQCQEGWHGRHCNKRYEASLIHALRPAGAQLRQHTPSLKKAEERRDPPESNYIW

SEQ ID NO: 14256 - protein, 133 aa, Homo Sapiens
MAPFTHDFRKAQQRMPAIPVNIHSMNFTWQAAGQAEYFYEFLSLRSLDKGIMADPTVNVPLLGTVPHKASVVQVGFPCLGKQDGVAAFEVDVIVMNSEGNTILQTPQNAIFFKTCQQAECPGGCRNGGFCNER

SEQ ID NO: 14257 - protein, 379 aa, Homo Sapiens
MARRSAFPAAALWLWSILLCLLALRAEAGPPQEESLYLWIDAHQARVLIGFEEDILIVSEGKMAPFTHDFRKAQQRMPAIPVNIHSMNFTWQAAGQAEYFYEFLSLRSLDKGIMADPTVNVPLLGTVPHKASVVQVGFPCLGKQDGVAAFEVDVIVMNSEGNTILQTPQNAIFFKTCQQAECPGGCRNGGFCNERRICECPDGFHGPHCEKALCTPRCMNGGLCVTPGFCICPPGFYGVNCDKANCSTTCFNGGTCFYPGKCICPPGLEGEQCEISKCPQPCRNGGKCIGKSKCKCSKGYQGDLCSKPVCEPGCGAHGTCHEPNKCQCQEGWHGRHCNKRYEASLIHALRPAGAQLRQHTPSLKKAEERRDPPESNYIW

SEQ ID NO: 14258 - protein, 122 aa, Homo Sapiens
MRWFLPWTLAAVTAAAASTVLATAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 14259 - protein, 280 aa, Homo Sapiens
MRWFLPWTLAAVTAAAASTVLATALSPAPTTMDFTPAPLEDTSSRPQFCKWPCECPPSPPRCPLGVSLITDGCECCKMCAQQLGDNCTEAAICDPHRGLYCDYSGDRPRYAIGVCAHAVGEVEAWHRNCIAYTSPWSPCSTSCGLGVSTRISNVNAQCWPEQESRLCNLRPCDVDIHTLIKAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 14260 - protein, 367 aa, Homo Sapiens
MRWFLPWTLAAVTAAAASTVLATALSPAPTTMDFTPAPLEDTSSRPQFCKWPCECPPSPPRCPLGVSLITDGCECCKMCAQQLGDNCTEAAICDPHRGLYCDYSGDRPRYAIGVCAQVVGVGCVLDGVRYNNGQSFQPNCKYNCTCIDGAVGCTPLCLRVRPPRLWCPHPRRVSIPGHCCEQWVCEDDAKRPRKTAPRDTGAFDAVGEVEAWHRNCIAYTSPWSPCSTSCGLGVSTRISNVNAQCWPEQESRLCNLRPCDVDIHTLIKAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 14261 - protein, 155 aa, Homo Sapiens
MRWFLPWTLAAVTAAAASTVLATALSPAPTTMDFTPAPLEDTSSRPQFCKWPCECPPSPPRCPLGVSLITDGCECCKMCAQQLGDNCTEAAICDPHRGLYCDYSGDRPRYAIGVCARREEVSGCVPARGIHELHTCGLHQHTLLSTQVLWSLHGQ

SEQ ID NO: 14262 - protein, 36 aa, Homo Sapiens
MRWFLPWTLAAVTAAAASTVLATMLWVRWRHGTGTA

SEQ ID NO: 14263 - protein, 218 aa, Homo Sapiens
MRGTPKTHLLAFSLLCLLSKVRTQLCPTPCTCPWPPPRCPLGVPLVLDGCGCCRVCARRLGEPCDQLHVCDASQGLVCQPGAGPGGRGALCLCKQDPSFLALSLPCPLVSPAQNGARPGDPARPPVGWAWPPGCPTRTASADWRPSAACACPGPAHPPGVAVHKTVPSRAGLGMGTRCPPSPAGGPVPGPWADGRWSVPRPLAAGNTLAWVHHAEHQY

SEQ ID NO: 14264 - protein, 250 aa, Homo Sapiens
MRGTPKTHLLAFSLLCLLSKVRTQLCPTPCTCPWPPPRCPLGVPLVLDGCGCCRVCARRLGEPCDQLHVCDASQGLVCQPGAGPGGRGALCLLAEDDSSCEVNGRLYREGETFQPHCSIRCRCEDGGFTCVPLCSEDVRLPSWDCPHPRRVEVLGKCCPEWVCGQGGGLGTQPLPAQGPQFSGLVSSLPPGVPCPEWSTAWGPCSTTCGLGMATRVSNQNRFCRLETQRRLCLSRPCPPSRGRSPQNSAF

SEQ ID NO: 14265 - protein, 250 aa, Homo Sapiens; identical to SEQ ID NO: 14264

SEQ ID NO: 14266 - protein, 321 aa, Homo Sapiens [sequence omitted]

SEQ ID NO: 14267 - protein, 130 aa, Homo Sapiens
MGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 14268 - protein, 372 aa, Homo Sapiens
MNKRRLLYPSGWLHGPSDMQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPAYRNLPLIWKKKCLVQATKWTPCSRTCGMGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 14269 - protein, 237 aa, Homo Sapiens
MNKRRLLYPSGWLHGPSDMQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPDVCQASNLLPALRSLNCCLPSSL

SEQ ID NO: 14270 - protein, 354 aa, Homo Sapiens
MQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPAYRNLPLIWKKKCLVQATKWTPCSRTCGMGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 14271 - protein, 354 aa, Homo Sapiens; identical to SEQ ID NO: 14270

SEQ ID NO: 14272 - protein, 354 aa, Homo Sapiens; identical to SEQ ID NO: 14270

SEQ ID NO: 14273 - protein, 219 aa, Homo Sapiens
MQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPDVCQASNLLPALRSLNCCLPSSL

SEQ ID NO: 14274 - protein, 2382 aa, Homo Sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVAQGQSQGQPSSSSLTGVSSSQPIQHPQQQQGIQQTAPPQQTVQYSLSQTSTSSEATTAQPVSQPQAPQVLPQVSAGKQLPVSQPVPTIQGEPQIPVATQPSVVPVHSGAHFLPVGQPLPTPLLPQYPVSQIPISTPHVSTAQTGFSSLPITMAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 14275 - protein, 2634 aa, Homo Sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVPRRGRSMSVCVPIFLLLPLCPASLPVLFHPTASTVCTSFSFPPPDCPEETFAEKLSKALESVLPMHSASQRKHRRSSLPSLFVSTPQSMAHPCGGTPTYPESQIFFPTIHERPVSFSPPPTCPPKVAISQRRKSTSFLEAQTHHFQPLLRTVGQSLLPPGGSPTNWTPEAVVMLGTTASRVTGESCEIQVHPMFEPSQVYSDYRPGLVLPEEAHYFIPQEAVYVAGVHYQARVAEQYEGIPYNSSVLSSPMKQIPEQKPVQGGPTSSSVFEFPSGQAFLVGHLQNLRLDSGLGPGSPLSSISAPISTDATRLKFHPVFVPHSAPAVLTHNNESRSNCVFEFHVHTPSSSSGEGGGILPQRVYRNRQVAVDLNQEELPPQSVGLHGYLQPVTEEKHNYHAPELTVSVVEPIGQNWPIGSPEYSSDSSQITSSDPSDFQSPPPTGGAAAPFGSDVSMPFIHLPQTVLQESPLFFCFPQGTTSQQVLTASFSSGGSALHPQAQGQSQGQPSSSSLTGVSSSQPIQHPQQQQGIQQTAPPQQTVQYSLSQTSTSSEATTAQPVSQPQAPQVLPQVSAGKQSTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 14276 - protein, 393 aa, Homo Sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGMFQVYLGA

SEQ ID NO: 14277 - protein, 2134 aa, Homo Sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVAQGQSQGQPSSSSLTGVSSSQPIQHPQQQGIQQTAPPQQTVQYSLSQTSTSSEATTAQPVSQPQAPQVLPQVSAGKQSTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 14278 - protein, 2833 aa, Homo Sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVPQSMAHPCGGTPTYPESQIFFPTIHERPVSFSPPPTCPPKVAISQRRKSTSFLEAQTHHFQPLLRTVGQSLLPPGGSPTNWTPEAVVMLGTTASRVTGESCEIQVHPMFEPSQVYSDYRPGLVLPEEAHYFIPQEAVYVAGVHYQARVAEQYEGIPYNSSVLSSPMKQIPEQKPVQGGPTSSSVFEFPSGQAFLVGHLQNLRLDSGLGPGSPLSSISAPISTDATRLKFHPVFVPHSAPAVLTHNNESRSNCVFEFHVHTPSSSSGEGGGILPQRVYRNRQVAVDLNQEELPPQSVGLHGYLQPVTEEKHNYHAPELTVSVVEPIGQNWPIGSPEYSSDSSQITSSDPSDFQSPPPTGGAAAPFGSDVSMPFIHLPQTVLQESPLFFCFPQGTTSQQVLTASFSSGGSALHPQAQGQSQGQPSSSSLTGVSSSQPIQHPQQQQGIQQTAPPQQTVQYSLSQTSTSSEATTAQPVSQPQAPQVLPQVSAGKQLPVSQPVPTIQGEPQIPVATQPSVVPVHSGAHFLPVGQPLPTPLLPQYPVSQIPISTPHVSTAQTGFSSLPITMAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGCAKFNCASEQVTFKPGGRRTRFLRKMVKKVCPCNQLCRTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 14279 - protein, 2642 aa, Homo Sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVPQSMAHPCGGTPTYPESQIFFPTIHERPVSFSPPPTCPPKVAISQRRKSTSFLEAQTHHFQPLLRTVGQSLLPPGGSPTNWTPEAVVMLGTTASRVTGESCEIQVHPMFEPSQVYSDYRPGLVLPEEAHYFIPQEAVYVAGVHYQARVAEQYEGIPYNSSVLSSPMKQIPEQKPVQGGPTSSSVFEFPSGQAFLVGHLQNLRLDSGLGPGSPLSSISAPISTDATRLKFHPVFVPHSAPAVLTHNNESRSNCVFEFHVHTPSSSSGEGGGILPQRVYRNRQVAVDLNQEELPPQSVGLHGYLQPVTEEKHNYHAPELTVSVVEPIGQNWPIGSPEYSSDSSQITSSDPSDFQSPPPTGGAAAPFGSDVSMPFIHLPQTVLQESPLFFCFPQGTTSQQVLTASFSSGGSALHPQAQGQSQGQPSSSSLTGVSSSQPIQHPQQQQGIQQTAPPQQTVQYSLSQTSTSSEATTAQPVSQPQAPQVLPQVSAGKQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 14280 - protein, 434 aa, Homo Sapiens
MYELLVLFMLIQPQSMAHPCGGTPTYPESQIFFPTIHERPVSFSPPPTCPPKVAISQRRKSTSFLEAQTHHFQPLLRTVGQSLLPPGGSPTNWTPEAVVMLGTTASRVTGESCEIQVHPMFEPSQVYSDYRPGLVLPEEAHYFIPQEAVYVAGVHYQARVAEQYEGIPYNSSVLSSPMKQIPEQKPVQGGPTSSSVFEFPSGQAFLVGHLQNLRLDSGLGPGSPLSSISAPISTDATRLKFHPVFVPHSAPAVLTHNNESRSNCVFEFHVHTPSSSSGEGGGILPQRVYRNRQVAVDLNQEELPPQSVGLHGYLQPVTEEKHNYHAPELTVSVVEPIGQNWPIGSPEYSSDSSQITSSDPSDFQSPPPTGGAAAPFGSDVSMPFIHLPQTVLQESPLFFCFPQGTTSQQVLTASFSSGGSALHPQVIGKLPQLF

SEQ ID NO: 14281 - protein, 240 aa, Homo Sapiens
PHSAPAVLTHNNESRSNCVFEFHVHTPSSSSGEGGGILPQRVYRNRQVAVDLNQEELPPQSVGLHGYLQPVTEEKHNYHAPELTVSVVEPIGQNWPIGSPEYSSDSSQITSSDPSDFQSPPPTGGAAAPFGSDVSMPFIHLPQTVLQESPLFFCFPQGTTSQQVLTASFSSGGSALHPQAQGQSQGQPSSSSLTGVSSSQPIQHPQQQQGIQQTAPPQQTVQYSLSQTSTSSEATTAQPV

SEQ ID NO: 14282 - protein, 67 aa, Homo Sapiens
SDNLYSAFTSDGAISVPSLSAPGQGCAKFNCASEQVTFKPGGRRTRFLSTPCLALWKMVKKVCPCNQ

SEQ ID NO: 14283 - protein, 245 aa, Homo Sapiens
SQPHGVYPPSSVQGIQQTAPPQQTVQYSLSQTSTSSEATTAQPVSQPQAPQVLPQVSAGKQLPVSQPVPTIQGEPQIPVATQPSVVPVHSGAHFLPVGQPLPTPLLPQYPVSQIPISTPHVSTAQTGFSSLPITMAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTV

SEQ ID NO: 14284 - protein, 195 aa, Homo Sapiens [sequence omitted]

SEQ ID NO: 14285 - protein, 218 aa, Homo Sapiens
  misc_feature (1)..(1): Xaa can be any naturally occurring amino acid
XADGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHN

SEQ ID NO: 14286 - protein, 177 aa, Homo Sapiens
  misc_feature (1)..(1): Xaa can be any naturally occurring amino acid
XEQAHSTGTVPGHIPSTVQAQSQPHGVYPPSSVAQGQSQGQPSSSSLTGVSSSQPIQHPQQQQGIQQTAPPQQTVQYSLSQTSTSSEATTAQPVSQPQAPQVLPQVSAGKQGFPPRLPPQYPGDSNIAPSSNVASVCIHSTVLSPPMPTEVLATPGYFPTVVQPYVESNLLVPMGGV

SEQ ID NO: 14287 - protein, 76 aa, Homo Sapiens
  misc_feature (1)..(1): Xaa can be any naturally occurring amino acid
XSDNLYSAFTSDGAISVPSLSAPGQGKMVKKVCPCNQLCRTSSTNTVGATVNSQAAQAQPPAMTSSRKGTFTDDLH

SEQ ID NO: 14288 - protein, 370 aa, Homo Sapiens
MGLWALLPGWVSATLLLALAALPAALAANSSGRWWGIVNVASSTNLLTDSKSLQLVLEPSLQLLSRKQRRLIRQNPGILHSVSGGLQSAVRECKWQFRNRRWNCPTAPGPHLFGKIVNRGCRETAFIFAITSAGVTHSVARSCSEGSIESCTCDYRRRGPGGPDWHWGGCSDNIDFGRLFGREFVDSGEKGRDLRFLMNLHNNEAGRTTVFSEMRQECKCHGMSGSCTVRTCWMRLPTLRAVGDVLRDRFDGASRVLYGNRGSNRASRAELLRLEPEDPAHKPPSPHDLVYFEKSPNFCTYSGRLGTAGTAGRACNSSSPALDGCELLCCGRGHRTRTQRVTERCNCTFHWCCHVSCRNCTHTRVLHECL

SEQ ID NO: 14289 - protein, 359 aa, Homo Sapiens
MGLWALLPGWVSATLLLALAALPAALAANSSGRWWGIVNVASSTNLLTDSKSLQLVLEPSLQLLSRKQRRLIRQNPGILHSVSGGLQSAVRECKWQFRNRRWNCPTAPGPHLFGKIVNRGCRETAFIFAITSAGVTHSVARSCSEGSIESCTCDYRRRGPGGPDWHWGGCSDNIDFGRLFGREFVDSGEKGRDLRFLMNLHNNEAGRTTVFSEMRQECKCHGMSGSCTVRTCWMRLPTLRAVGDVLRDRFDGASRVLYGNRGSNRASRAELLRLEPDLVYFEKSPNFCTYSGRLGTAGTAGRACNSSSPALDGCELLCCGRGHRTRTQRVTERCNCTFHWCCHVSCRNCTHTRVLHECL

SEQ ID NO: 14290 - protein, 102 aa, Homo Sapiens
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGR

SEQ ID NO: 14291 - protein, 191 aa, Homo Sapiens
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGRLPHHSAILKRGFRESAFSFSMLAAGVMHAVATACSLGKLVSCGCGWKGSGEQDRLRAKLLQLQALSRGKLPGTSRHECESTTTGWGARW

SEQ ID NO: 14292 - protein, 389 aa, Homo Sapiens
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGRLPHHSAILKRGFRESAFSFSMLAAGVMHAVATACSLGKLVSCGCGWKGSGEQDRLRAKLLQLQALSRGKSFPHSLPSPGPGSSPSPGPQDTWEWGGCNHDMDFGEKFSRDFLDSREAPRDIQARMRIHNNRVGRQVVTENLKRKCKCHGTSGSCQFKTCWRAAPEFRAVGAALRERLGRAIFIDTHNRNSGAFQPRLRPRRLSGELVYFEKSPDFCERDPTMGSPGTRGRACNKTSRLLDGCGSLCCGRGHNVLRQTRVERCHCRFHWCCYVLCDECKVTEWVNVCK

SEQ ID NO: 14293 - protein, 173 aa, Homo Sapiens
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGRLPHHSAILKRGFRESAFSFSMLAAGVMHAVATACSLGKLVSCGCGWKGSGKLPGTSRHECESTTTGWGARW

SEQ ID NO: 14294 - protein, 132 aa, Homo Sapiens
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGRLPHHSAILKRGPGVGEGLDTQMVSEKVLFP

SEQ ID NO: 14295 - protein, 5 aa, Homo Sapiens
MRARP

SEQ ID NO: 14296 - protein, 354 aa, Homo Sapiens
MRARPQVCEALLFALALQTGVCYGIKWLALSKTPSALALNQTQHCKQLEGLVSAQVQLCRSNLELMHTVVHAAREVMKACRRAFADMRWNCSSIELAPNYLLDLERGTRESAFVYALSAAAISHAIARACTSGDLPGCSCGPVPGEPPGPGNRWGGCADNLSYGLLMGAKFSDAPMKVKKTGSQANKLMRLHNSEVGRQALRASLEMKCKCHGVSGSCSIRTCWKGLQELQDVAADLKTRYLSATKVVHRPMGTRKHLVPKDLDIRPVKDSELVYLQSSPDFCMKNEKVGSHGTQDRQCNKTSNGSDSCDLMCCGRGYNPYTDRVVERCHCKYHWCCYVTCRRCERTVERYVCK

SEQ ID NO: 14297 - protein, 262 aa, Homo Sapiens
MRARPQVCEALLFALALQTGVCYGIKWLALSKTPSALALNQTQHCKQLEGLVSAQVQLCRSNLELMHTVVHAAREVMKACRRAFADMRWNCSSIELAPNYLLDLERGTRESAFVYALSAAAISHAIARACTSGDLQELQDVAADLKTRYLSATKVVHRPMGTRKHLVPKDLDIRPVKDSELVYLQSSPDFCMKNEKVGSHGTQDRQCNKTSNGSDSCDLMCCGRGYNPYTDRVVERCHCKYHWCCYVTCRRCERTVERYVCK

SEQ ID NO: 14298 - protein, 365 aa, Homo Sapiens
MDRAALLGLARLCALWAALLVLFPYGAQGNWMWLGIASFGVPEKLGCANLPLNSRQKELCKRKPYLLPSIREGARLGIQECGSQFRHERWNCMITAAATTAPMGASPLFGYELSSGTKETAFIYAVMAAGLVHSVTRSCSAGNMTECSCDTTLQNGGSASEGWHWGGCSDDVQYGMWFSRKFLDFPIGNTTGKENKVLLAMNLHNNEAGRQAVAKLMSVDCRCHGVSGSCAVKTCWKTMSSFEKIGHLLKDKYENSIQISDKTKRKMRRREKDQRKIPIHKDDLLYVNKSPNYCVEDKKLGIPGTQGRECNRTSEGADGCNLLCCGRGYNTHVVRHVERCECKFIWCCYVRCRRCESMTDVHTCK

SEQ ID NO: 14299 - protein, 355 aa, Homo Sapiens
MQLTTCLRETLFTGASQKTSLWWLGIASFGVPEKLGCANLPLNSRQKELCKRKPYLLPSIREGARLGIQECGSQFRHERWNCMITAAATTAPMGASPLFGYELSSGTKETAFIYAVMAAGLVHSVTRSCSAGNMTECSCDTTLQNGGSASEGWHWGGCSDDVQYGMWFSRKFLDFPIGNTTGKENKVLLAMNLHNNEAGRQAVAKLMSVDCRCHGVSGSCAVKTCWKTMSSFEKIGHLLKDKYENSIQISDKTKRKMRRREKDQRKIPIHKDDLLYVNKSPNYCVEDKKLGIPGTQGRECNRTSEGADGCNLLCCGRGYNTHVVRHVERCECKFIWCCYVRCRRCESMTDVHTCK

SEQ ID NO: 14300 - protein, 110 aa, Homo Sapiens
MNAPLGGIWLWLPLLLTWLTPEVNSSWWYMRATGGSSRVMCDNVPGLVSSQRQLCHRHPDVMRAISQGVAEWTAECQHQFRQHRWNCNTLDRDHSLFGRVLLRRPVAKEK

SEQ ID NO: 14301 - protein, 153 aa, Homo Sapiens
MNAPLGGIWLWLPLLLTWLTPEVNSSWWYMRATGGSSRVMCDNVPGLVSSQRQLCHRHPDVMRAISQGVAEWTAECQHQFRQHRWNCNTLDRDHSLFGRVLLRSCKAVLETRVQVPRGERLMYSQDMLAGHGRLQENGRLSLEEVQWGHPGGH

SEQ ID NO: 14302 - protein, 360 aa, Homo Sapiens
MNAPLGGIWLWLPLLLTWLTPEVNSSWWYMRATGGSSRVMCDNVPGLVSSQRQLCHRHPDVMRAISQGVAEWTAECQHQFRQHRWNCNTLDRDHSLFGRVLLRSSRESAFVYAISSAGVVFAITRACSQGEVKSCSCDPKKMGSAKDSKGIFDWGGCSDNIDYGIKFARAFVDAKERKGKDARALMNLHNNRAGRKAVKRFLKQECKCHGVSGSCTLRTCWLAMADFRKTGDYLWRKYNGAIQVVMNQDGTGFTVANERFKKPTKNDLVYFENSPDYCIRDREAGSLGTAGRVCNLTSRGMDSCEVMCCGRGYDTSHVTRMTKCGCKFHWCCAVRCQDCLEALDVHTCKAPKNADWTTAT

SEQ ID NO: 14303 - protein, 355 aa, Homo Sapiens
MEPHLLGLLLGLLLGGTRVLAGYPIWWSLALGQQYTSLGSQPLLCGSIPGLVPKQLRFCRNYIEIMPSVAEGVKLGIQECQHQFRGRRWNCTTIDDSLAIFGPVLDKATRESAFVHAIASAGVAFAVTRSCAEGTSTICGCDSHHKGPPGEGWKWGGCSEDADFGVLVSREFADARENRPDARSAMNKHNNEAGRTTILDHMHLKCKCHGLSGSCEVKTCWWAQPDFRAIGDFLKDKYDSASEMVVEKHRESRGWVETLRAKYSLFKPPTERDLVYYENSPNFCEPNPETGSFGTRDRTCNVTSHGIDGCDLLCCGRGHNTRTEKRKEKCHCIFHWCCYVSCQECIRIYDVHTCK

SEQ ID NO: 14304 - protein, 352 aa, Homo Sapiens
MAPLGYFLLLCSLKQALGSYPIWWSLAVGPQYSSLGSQPILCASIPGLVPKQLRFCRNYVEIMPSVAEGIKIGIQECQHQFRGRRWNCTTVHDSLAIFGPVLDKATRESAFVHAIASAGVAFAVTRSCAEGTAAICGCSSRHQGSPGKGWKWGGCSEDIEFGGMVSREFADARENRPDARSAMNRHNNEAGRQAIASHMHLKCKCHGLSGSCEVKTCWWSQPDFRAIGDFLKDKYDSASEMVVEKHRESRGWVETLRPRYTYFKVPTERDLVYYEASPNFCEPNPETGSFGTRDRTCNVSSHGIDGCDLLCCGRGHNARAERRREKCRCVFHWCCYVSCQECTRVYDVHTCK

SEQ ID NO: 14305 - protein, 365 aa, Homo Sapiens
MAGSAMSSKFFLVALAIFFSFAQVVIEANSWWSLGMNNPVQMSEVYIIGAQPLCSQLAGLSQGQKKLCHLYQDHMQYIGEGAKTGIKECQYQFRHRRWNCSTVDNTSVFGRVMQIGSRETAFTYAVSAAGVVNAMSRACREGELSTCGCSRAARPKDLPRDWLWGGCGDNIDYGYRFAKEFVDARERERIHAKGSYESARILMNLHNNEAGRRTVYNLADVACKCHGVSGSCSLKTCWLQLADFRKVGDALKEKYDSAAAMRLNSRGKLVQVNSRFNSPTTQDLVYIDPSPDYCVRNESTGSLGTQGRLCNKTSEGMDGCELMCCGRGYDQFKTVQTERCHCKFHWCCYVKCKKCTEIVDQFVCK

SEQ ID NO: 14306 - protein, 214 aa, Homo Sapiens
MAGSAMSSKFFLVALAIFFSFAQVVIEANSWWSLGMNNPVQMSEVYIIGAQPLCSQLAGLSQGQKKLCHLYQDHMQYIGEGAKTGIKECQYQFRHRRWNCSTVDNTSVFGRVMQIGSRETAFTYAVSAAGVVNAMSRACREGELSTCGCSRAARPKDLPRDWLWGGCGDNIDYGYRFAKEFVDARERERIHAKGSYESARILMNLHNNEAGRRV

SEQ ID NO: 14307 - protein, 380 aa, Homo Sapiens
MKKSIGILSPGVALGMAGSAMSSKFFLVALAIFFSFAQVVIEANSWWSLGMNNPVQMSEVYIIGAQPLCSQLAGLSQGQKKLCHLYQDHMQYIGEGAKTGIKECQYQFRHRRWNCSTVDNTSVFGRVMQIGSRETAFTYAVSAAGVVNAMSRACREGELSTCGCSRAARPKDLPRDWLWGGCGDNIDYGYRFAKEFVDARERERIHAKGSYESARILMNLHNNEAGRRTVYNLADVACKCHGVSGSCSLKTCWLQLADFRKVGDALKEKYDSAAAMRLNSRGKLVQVNSRFNSPTTQDLVYIDPSPDYCVRNESTGSLGTQGRLCNKTSEGMDGCELMCCGRGYDQFKTVQTERCHCKFHWCCYVKCKKCTEIVDQFVCK

SEQ ID NO: 14308 - protein, 380 aa, Homo Sapiens; identical to SEQ ID NO: 14307

SEQ ID NO: 14309 - protein, 112 aa, Homo Sapiens
MPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGCV

SEQ ID NO: 14310 - protein, 118 aa, Homo Sapiens
MPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGSRETAFTH

SEQ ID NO: 14311 - protein, 157 aa, Homo Sapiens
MPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGSRETAFTHAVSAAGVVNAISRACREGELSTCGCSRTARPKDLPRDWL

SEQ ID NO: 14312 - protein, 254 aa, Homo Sapiens
MPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGSRETAFTHAVSAAGVVNAISRACREGELSTCGCSRTARPKDLPRDWLWGGCGDNVEYGYRFAKEFVDAREREKNFAKGSEEQGRVLMNLQNNEAGRRAVYKMADVACKCHGVSGSCSLKTCWLQLAEFRKVGDRLKEKYDSAAA

SEQ ID NO: 14313 - protein, 359 aa, Homo Sapiens
MPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGSRETAFTHAVSAAGVVNAISRACREGELSTCGCSRTARPKDLPRDWLWGGCGDNVEYGYRFAKEFVDAREREKNFAKGSEEQGRVLMNLQNNEAGRRAVYKMADVACKCHGVSGSCSLKTCWLQLAEFRKVGDRLKEKYDSAAAMRVTRKGRLELVNSRFTQPTPEDLVYVDPSPDYCLRNESTGSLGTQGRLCNKTSEGMDGCELMCCGRGYNQFKSVQVERCHCKFHWCCFVRCKKCTEIVDQYICK

SEQ ID NO: 14314 - protein, 359 aa, Homo Sapiens; identical to SEQ ID NO: 14313

SEQ ID NO: 14315 - protein, 359 aa, Homo Sapiens; identical to SEQ ID NO: 14313

SEQ ID NO: 14316 - protein, 365 aa, Homo Sapiens
MLPPLPSRLGLLLLLLLCPAHVGGLWWAVGSPLVMDPTSICRKARRLAGRQAELCQAEPEVVAELARGARLGVRECQFQFRFRRWNCSSHSKAFGRILQQDIRETAFVFAITAAGASHAVTQACSMGELLQCGCQAPRGRAPPRPSGLPGTPGPPGPAGSPEGSAAWEWGGCGDDVDFGDEKSRLFMDARHKRGRGDIRALVQLHNNEAGRLAVRSHTRTECKCHGLSGSCALRTCWQKLPPFREVGARLLERFHGASRVMGTNDGKALLPAVRTLKPPGRADLLYAADSPDFCAPNRRTGSPGTRGRACNSSAPDLSGCDLLCCGRGHRQESVQLEENCLCRFHWCCVVQCHRCRVRKELSLCL

SEQ ID NO: 14317 - protein, 349 aa, Homo Sapiens
MNRKARRCLGHLFLSLGMVYLRIGGFSSVVALGASIICNKIPGLAPRQRAICQSRPDAIIVIGEGSQMGLDECQFQFRNGRWNCSALGERTVFGKELKVGSREAAFTYAIIAAGVAHAITAACTQGNLSDCGCDKEKQGQYHRDEGWKWGGCSADIRYGIGFAKVFVDAREIKQNARTLMNLHNNEAGRKILEENMKLECKCHGVSGSCTTKTCWTTLPQFRELGYVLKDKYNEAVHVEPVRASRNKRPTFLKIKKPLSYRKPMDTDLVYIEKSPNYCEEDPVTGSVGTQGRACNKTAPQASGCDLMCCGRGYNTHQYARVWQCNCKFHWCCYVKCNTCSERTEMYTCK

SEQ ID NO: 14318 - protein, 57 aa, Homo Sapiens
MGINECQYQFRFGRWNCSALGEKTVFGQELRVGSREAAFTYAITAAGVAHAVTAACS

SEQ ID NO: 14319 - protein, 205 aa, Homo Sapiens
MHRNFRKWIFYVFLCFGVLYVKLGALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKGLLGQPRVTSSPLFP

SEQ ID NO: 14320 - protein, 349 aa, Homo Sapiens
MHRNFRKWIFYVFLCFGVLYVKLGALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKVLEDRMQLECKCHGVSGSCTTKTCWTTLPKFREVGHLLKEKYNAAVQVEVVRASRLRQPTFLRIKQLRSYQKPMETDLVYIEKSPNYCEEDAATGSVGTQGRLCNRTSPGADGCDTMCCGRGYNTHQYTKVWQCNCKFHWCCFVKCNTCSERTEVFTCK

SEQ ID NO: 14321 - protein, 353 aa, Homo Sapiens
MLLLSPRSALVSVYCPQIFLLLSSGSYLALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKVLEDRMQLECKCHGVSGSCTTKTCWTTLPKFREVGHLLKEKYNAAVQVEVVRASRLRQPTFLRIKQLRSYQKPMETDLVYIEKSPNYCEEDAATGSVGTQGRLCNRTSPGADGCDTMCCGRGYNTHQYTKVWQCNCKFHWCCFVKCNTCSERTEVFTCK

SEQ ID NO: 14322 - protein, 333 aa, Homo Sapiens
MSAPPFYRALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKVLEDRMQLECKCHGVSGSCTTKTCWTTLPKFREVGHLLKEKYNAAVQVEVVRASRLRQPTFLRIKQLRSYQKPMETDLVYIEKSPNYCEEDAATGSVGTQGRLCNRTSPGADGCDTMCCGRGYNTHQYTKVWQCNCKFHWCCFVKCNTCSERTEVFTCK

SEQ ID NO: 14323 - protein, 355 aa, Homo Sapiens
MGNLFMLWAALGICCAAFSASAWSVNNFLITGPKAYLTYTTSVALGAQSGIEECKFQFAWERWNCPENALQLSTHNRLRSATRETSFIHAISSAGVMYIITKNCSMGDFENCGCDGSNNGKTGGHGWIWGGCSDNVEFGERISKLFVDSLEKGKDARALMNLHNNRAGRLAVRATMKRTCKCHGISGSCSIQTCWLQLAEFREMGDYLKAKYDQALKIEMDKRQLRAGNSAEGHWVPAEAFLPSAEAELIFLEESPDYCTCNSSLGIYGTEGRECLQNSHNTSRWERRSCGRLCTECGLQVEERKTEVISSCNCKFQWCCTVKCDQCRHVVSKYYCARSPGSAQSLGRVWFGVYI

SEQ ID NO: 14324 - protein, 351 aa, Homo Sapiens
MGNLFMLWAALGICCAAFSASAWSVNNFLITGPKAYLTYTTSVALGAQSGIEECKFQFAWERWNCPENALQLSTHNRLRSATRETSFIHAISSAGVMYIITKNCSMGDFENCGCDGSNNGKTGGHGWIWGGCSDNVEFGERISKLFVDSLEKGKDARALMNLHNNRAGRLAVRATMKRTCKCHGISGSCSIQTCWLQLAEFREMGDYLKAKYDQALKIEMDKRQLRAGNSAEGHWVPAEAFLPSAEAELIFLEESPDYCTCNSSLGIYGTEGRECLQNSHNTSRWERRSCGRLCTECGLQVEERKTEVISSCNCKFQWCCTVKCDQCRHVVSKYYCARSPGSAQSLGKGSA

SEQ ID NO: 14325 - protein, 369 aa, Homo Sapiens
MLCCIQCLCLVSPFPTLTPCQGGPHCLIPIHLCLTFSLFGRSVNNFLITGPKAYLTYTTSVALGAQSGIEECKFQFAWERWNCPENALQLSTHNRLRSATRETSFIHAISSAGVMYIITKNCSMGDFENCGCDGSNNGKTGGHGWIWGGCSDNVEFGERISKLFVDSLEKGKDARALMNLHNNRAGRLAVRATMKRTCKCHGISGSCSIQTCWLQLAEFREMGDYLKAKYDQALKIEMDKRQLRAGNSAEGHWVPAEAFLPSAEAELIFLEESPDYCTCNSSLGIYGTEGRECLQNSHNTSRWERRSCGRLCTECGLQVEERKTEVISSCNCKFQWCCTVKCDQCRHVVSKYYCARSPGSAQSLGKGSA

SEQ ID NO: 14326 - protein, 360 aa, Homo Sapiens
MLCCIQCLCLVSPFPTLTPCQGGPHCLIPIHLCLTFSLFGRSVNNFLITGPKAYLTYTTSVALGAQSGIEECKFQFAWERWNCPENALQLSTHNRLRSATRETSFIHAISSAGVMYIITKNCSMGDFENCGCDGSNNGKTGGHGWIWGGCSDNVEFGERISKLFVDSLEKGKDARALMNLHNNRAGRLAVRATMKRTCKCHGISGSCSIQTCWLQLAEFREMGDYLKAKYDQALKIEMDKRQLRAGNSAEGHWVPAEAFLPSAEAELIFLEESPDYCTCNSSLGIYGTEGRECLQNSHNTSRWERRSCGRLCTECGLQVEERKTEVISSCNCKFQWCCTVKCDQCRHVTMSNPAVLLGIR

SEQ ID NO: 14327 - protein, 351 aa, Homo Sapiens
MFLSKPSVYICLFTCVLQLSHSWSVNNFLMTGPKAYLIYSSSVAAGAQSGIEECKYQFAWDRWNCPERALQLSSHGGLRSANRETAFVHAISSAGVMYTLTRNCSLGDFDNCGCDDSRNGQLGGQGWLWGGCSDNVGFGEAISKQFVDALETGQDARAAMNLHNNEAGRKAVKGTMKRTCKCHGVSGSCTTQTCWLQLPEFREVGAHLKEKYHAALKVDLLQGAGNSAAGRGAIADTFRSISTRELVHLEDSPDYCLENKTLGLLGTEGRECLRRGRALGRWERRSCRRLCGDCGLAVEERRAETVSSCNCKFHWCCAVRCEQCRRRVTKYFCSRAERPRGGAAHKPGRKP

SEQ ID NO: 14328 - protein, 365 aa, Homo Sapiens
MLDGSPLARWLAAAFGLTLLLAALRPSAAYFGLTGSEPLTILPLTLEPEAAAQAHYKACDRLKLERKQRRMCRRDPGVAETLVEAVSMSALECQFQFRFERWNCTLEGRYRASLLKRGFKETAFLYAISSAGLTHALAKACSAGRMERCTCDEAPDLENREAWQWGGCGDNLKYSSKFVKEFLGRRSSKDLRARVDFHNNLVGVKVIKAGVETTCKCHGVSGSCTVRTCWRQLAPFHEVGKHLKHKYETALKVGSTTNEAAGEAGAISPPRGRASGAGGSDPLPRTPELVHLDDSPSFCLAGRFSPGTAGRRCHREKNCESICCGRGHNTQSRVVTRPCQCQVRWCCYVECRQCTQREEVYTCKG

SEQ ID NO: 14329 - protein, 133 aa, Homo Sapiens
MKGRAVSFDPLACQGLNASPGSLTSPLRRIRSLTGREVLTPFPGLGTAAAPAQGGAHLKQCDLLKLSRRQKQLCRREPGLAETLRDAAHLGLLECQFQFRHERWNCSLEGRMGLLKRGFKETAFLYAVSSAAL

SEQ ID NO: 14330 - protein, 357 aa, Homo Sapiens
MRPPPALALAGLCLLALPAAAASYFGLTGREVLTPFPGLGTAAAPAQGGAHLKQCDLLKLSRRQKQLCRREPGLAETLRDAAHLGLLECQFQFRHERWNCSLEGRMGLLKRGFKETAFLYAVSSAALTHTLARACSAGRMERCTCDDSPGLESRQAWQWGVCGDNLKYSTKFLSNFLGSKRGNKDLRARADAHNTHVGIKAVKSGLRTTCKCHGVSGSCAVRTCWKQLSPFRETGQVLKLRYDSAVKVSSATNEALGRLELWAPARQGSLTKGLAPRSGDLVYMEDSPSFCRPSKYSPGTAGRVCSREASCSSLCCGRGYDTQSRLVAFSCHCQVQWCCYVECQQCVQEELVYTCKH

SEQ ID NO: 14331 - protein, 329 aa, Homo Sapiens
MRPPPALALAGLCLLALPAAAASYFGLTGREVLTPFPGLGTAAAPAQGGAHLKQCDLLKLSRRQKQLCRREPGLAETLRDAAHLGLLECQFQFRHERWNCSLEGRMGLLKRGFKETAFLYAVSSAALTHTLARACSAGRMERCTCDDSPGLESRQAWQWGVCGDNLKYSTKFLSNFLGSKRGNKDLRARADAHNTHVGIKAVKSGLRTTCKCHGVSGSCAVRTCWKQLSPFRETGQVLKLRYDSAVKVSSATNEALGRLELWAPARQGSLTKGLAPRSGDLVYMEDSPSFCRPSKYSPGTAGWSAVARSQLITTSTSRIQAILPSQLPE

SEQ ID NO: 14332 - protein, 78 aa, Homo Sapiens
MASFPPRVNEKEIAPAAPFDKKCGRENWTVAFAPDGSYFAWSQGHRTVKLVPWSQCLQNFLLHGTKNVTNSSSLRLPR

SEQ ID NO: 14333 - protein, 213 aa, Homo Sapiens
MASFPPRVNEKEIDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDLKDDGNMMKVLRGHQNWVYSCAFSPDSSMLCSVGASKAVVAAILV

SEQ ID NO: 14334 - protein, 143 aa, Homo Sapiens
MASFPPRVNEKEIGKLLLNLVDHTEVVRDLTFAPDGSLILVSASRDKTLRVWDLKDDGNMMKVLRGHQNWVYSCAFSPDSSMLCSVGASKAVFLWNMDKYTMIRKLEGHHHDVVACDFSPDGALLATASYDTRVYIWDPHNGD

SEQ ID NO: 14335 - protein, 275 aa, Homo Sapiens
MASFPPRVNEKEIGKLLLNLVDHTEVVRDLTFAPDGSLILVSASRDKTLRVWDLKDDGNMMKVLRGHQNWVYSCAFSPDSSMLCSVGASKAVFLWNMDKYTMIRKLEGHHHDVVACDFSPDGALLATASYDTRVYIWDPHNGDILMEFGHLFPPPTPIFAGGANDRWVRSVSFSHDGLHVASLADDKMVRFWRIDEDYPVQVAPLSNGLCCAFSTDGSVLAAGTHDGSVYFWATPRQVPSLQHLCRMSIRRVMPTQEVQELPIPSKLLEFLSYRI

SEQ ID NO: 14336 - protein, 98 aa, Homo Sapiens
MASFPPRVNEKEIGKLLLNLVDHTEVVRDLTFAPDGSLILVSASRDKTLRVWDLKDDGNMMKVLRGHQNWVYSCAFSPDSSMLCSVGASKAVVAAILV

SEQ ID NO: 14337 - protein, 54 aa, Homo Sapiens
MASFPPRVNEKEIGNMMKVLRGHQNWVYSCAFSPDSSMLCSVGASKAVVAAILV

SEQ ID NO: 14338 - protein, 207 aa, Homo Sapiens
MASFPPRVNEKEIVFLFFLLVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDL

SEQ ID NO: 14339 - protein, 421 aa, Homo Sapiens
MASFPPRVNEKEIVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDLKDDGNMMKVLRGHQNWVYSCAFSPDSSMLCSVGASKAVFLWNMDKYTMIRKLEGHHHDVVACDFSPDGALLATASYDTRVYIWDPHNGDILMEFGHLFPPPTPIFAGGANDRWVRSVSFSHDGLHVASLADDKMVRFWRIDEDYPVQVAPLSNGLCCAFSTDGSVLAAGTHDGSVYFWATPRQVPSLQHLCRMSIRRVMPTQEVQELPIPSKLLEFLSYRI

SEQ ID NO: 14340 - protein, 247 aa, Homo Sapiens
MASFPPRVNEKEIVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDLKDDGNMMKVLRGHQNWVYSCAFSPDSSMLCSVGASKAVRVKVLVHSL

SEQ ID NO: 14341 - protein, 74 aa, Homo Sapiens
MASFPPRVNEKEIVRLRTIGELLAPAAPFDKKCGRENWTVAFAPDGSYFAWSQGHRTVKLVPWSQCLQNLKTPP

SEQ ID NO: 14342 - protein, 459 aa, Homo Sapiens
MAEQGRCCDLAALGEQGGAPPWEKSLGTYIGCFSDDGHERTLKGAVFYDLRKMTVSHCQDACAERSYVYAGLEAGAECYCGNRLPAVSVGLEECNHECKGEKGSVCGAVDRLSVYRVDELQPGSRKRRTATYRGCFRLPENITHAFPSSLIQANVTVGTCSGFCSQKEFPLAILRGWECYCAYPTPRFNLRDAMDSSVCGQDPEAQRLAEYCEVYQTPVQDTRCTDRRFLPNKSKVFVALSSFPGAGNTWARHLIEHATGFYTGSYYFDGTLYNKGFKGEKDHWRSRRTICVKTHESGRREIEMFDSAILLIRNPYRSLVAEFNRKCAGHLGYAADRNWKSKEWPDFVNSYASWWSSHVLDWLKYGKRLLVVHYEELRRSLVPTLREMVAFLNVSVSEERLLCVENNKEGSFRRRGRRSHDPEPFTPEMKDLINGYIRTVDQALRDHNWTGLPREYVPR

SEQ ID NO: 14343 - protein, 45 aa, Homo Sapiens
MAKPFFRLQKFLRRTQFLLFFLTAAYLMTGSLLLLQRVRVALPQG

SEQ ID NO: 14344 - protein, 87 aa, Homo Sapiens
MAKPFFRLQKFLRRTQFLLFFLTAAYLMTGSLLLLQRVRVALPQGPRAPGPLQTLPVAAVALGVGLLDSRALHDPRVSPELLLGVDM

SEQ ID NO: 14345 - protein, 181 aa, Homo Sapiens
MAKPFFRLQKFLRRTQFLLFFLTAAYLMTGSLLLLQRVRVALPQGPRAPGPLQTLPVAAVALGVGLLDSRALHDPRVSPELLLGVDMLQSPLTRPRPGPRWLRSRNSELRQLRRRWFHHFMSDSQGPPALGPEAARPAIHSRGTYIGCFSDDGHERTLKGAVFYDLRKMTVSHCQDACAER

SEQ ID NO: 14346 - protein, 575 aa, Homo Sapiens
MAKPFFRLQKFLRRTQFLLFFLTAAYLMTGSLLLLQRVRVALPQGPRAPGPLQTLPVAAVALGVGLLDSRALHDPRVSPELLLGVDMLQSPLTRPRPGPRWLRSRNSELRQLRRRWFHHFMSDSQGPPALGPEAARPAIHSRGTYIGCFSDDGHERTLKGAVFYDLRKMTVSHCQDACAERSYVYAGLEAGAECYCGNRLPAVSVGLEECNHECKGEKGSVCGAVDRLSVYRVDELQPGSRKRRTATYRGCFRLPENITHAFPSSLIQANVTVGTCSGFCSQKEFPLAILRGWECYCAYPTPRFNLRDAMDSSVCGQDPEAQRLAEYCEVYQTPVQDTRCTDRRFLPNKSKVFVALSSFPGAGNTWARHLIEHATGFYTGSYYFDGTLYNKGFKGEKDHWRSRRTICVKTHESGRREIEMFDSAILLIRNPYRSLVAEFNRKCAGHLGYAADRNWKSKEWPDFVNSYASWWSSHVLDWLKYGKRLLVVHYEELRRSLVPTLREMVAFLNVSVSEERLLCVENNKEGSFRRRGRRSHDPEPFTPEMKDLINGYIRTVDQALRDHNWTGLPREYVPR

SEQ ID NO: 14347 - protein, 575 aa, Homo Sapiens; identical to SEQ ID NO: 14346

SEQ ID NO: 14348 - protein, 575 aa, Homo Sapiens; identical to SEQ ID NO: 14346

SEQ ID NO: 14349 - protein, 575 aa, Homo Sapiens; identical to SEQ ID NO: 14346

SEQ ID NO: 14350 - protein, 26 aa, Homo Sapiens
MTVSHCQDACAERSYVYAGLEAGAEC

SEQ ID NO: 14351 - protein, 136 aa, Homo Sapiens
  misc_feature (1)..(1): Xaa can be any naturally occurring amino acid
XGSLLLLQRVRVALPQGPRAPGPLQTLPVAAVALGVGLLDSRALHDPRVSPELLLGVDMLQSPLTRPRPGPRWLRSRNSELRQLRRRWFHHFMSDSQGPPALGPEAARPAIHSRGPMSTPAWRPGRSVTAGTGCQR

SEQ ID NO: 14352 - protein, 565 aa, Homo Sapiens
MAKLWFKFQRYFRRKPVRFFTFLALYLTAGSLVFLHSGFVGQPAVSGNQANPAAAGGPAEGAELSFLGDMHLGRGFRDTGEASSIARRYGPWFKGKDGNERAKLGDYGGAWSRALKGRVVREKEEERAKYIGCYLDDTQSRALRGVSFFDYKKMTIFRCQDNCAERGYLYGGLEFGAECYCGHKIQATNVSEAECDMECKGERGSVCGGANRLSVYRLQLAQESARRYGSAVFRGCFRRPDNLSLALPVTAAMLNMSVDKCVDFCTEKEYPLAALAGTACHCGFPTTRFPLHDREDEQLCAQKCSAEEFESCGTPSYFIVYQTQVQDNRCMDRRFLPGKSKQLIALASFPGAGNTWARHLIELATGFYTGSYYFDGSLYNKGFKGERDHWRSGRTICIKTHESGQKEIEAFDAAILLIRNPYKALMAEFNRKYGGHIGFAAHAHWKGKEWPEFVRNYAPWWATHTLDWLKFGKKVLVVHFEDLKQDLFVQLGRMVSLLGVAVREDRLLCVESQKDGNFKRSGLRKLEYDPYTADMQKTISAYIKMVDAALKGRNLTGVPDDYYPR

SEQ ID NO: 14353 - protein, 565 aa, Homo Sapiens; identical to SEQ ID NO: 14352

SEQ ID NO: 14354 - protein, 585 aa, Homo Sapiens
MAKLWFKFQRYFRRKPVRFFTFLALYLTAGSLVFLHSGFVGQPAVSGNQANPAAAGGPAEGAELSFLGDMHLGRGFRDTGEASSIARRYGPWFKGKDGNERAKLGDYGGAWSRALKGRVVREKEEERAKYIGCYLDDTQSRALRGVSFFDYKKMTIFRCQDNCAERGYLYGGLEFGAECYCGHKIQATNVSEAECDMECKGERGSVCGGANRLSVYRLQLAQESARRYGSAVFRGCFRRPDNLSLALPVTAAMLNMSVDKCVDFCTEKEYPLAALAGTACHCGFPTTRFPLHDREDEQLCAQKCSAEEFESCGTPSYFIVYQTQVQDNRCMDRRFLPGKSKQLIALASFPGAGNTWARHLIELATGFYTGSYYFDGSLYNKGFKGERDHWRSGRTICIKTHESGQKEIEAFDAAILLIRNPYKALMAEFNRKYGGHIGFAAHAHWKGKGAVPGSLQILFRSICTASVGEWPEFVRNYAPWWATHTLDWLKFGKKVLVVHFEDLKQDLFVQLGRMVSLLGVAVREDRLLCVESQKDGNFKRSGLRKLEYDPYTADMQKTISAYIKMVDAALKGRNLTGVPDDYYPR

SEQ ID NO: 14355 - protein, 124 aa, Homo Sapiens
MTIFRCQDNCAERGYLYGGLEFGAECYCGHKIQATNVSEAECDMECKGERGSVCGGANRLSVYRLQLAQESARRYGSAVFRGCFRRPDNLSLALPVTAAMLNMSVDKCVDFCTEKEYPLAALAG

SEQ ID NO: 14356 - protein, 114 aa, Homo Sapiens
MRLLILALLGICSLTAYIVEGVGSEVSDKRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 14357 - protein, 114 aa, Homo Sapiens
MRLLILALLGICSLTAYIVEGVGSEVSHRRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 14358 - protein, 674 aa, Homo Sapiens
MARAHWGCCPWLVLLCACAWGHTKPVDLGGQDVRNCSTNPPYLPVTVVNTTMSLTALRQQMQTQNLSAYIIPGTDAHMNEYIGQHDERRAWITGFTGSAGTAVVTMKKAAVWTDSRYWTQAERQMDCNWELHKEVGTTPIVTWLLTEIPAGGRVGFDPFLLSIDTWESYDLALQGSNRQLVSITTNLVDLVWGSERPPVPNQPIYALQEAFTGSTWQEKVSGVRSQMQKHQKVPTAVLLSALEETAWLFNLRASDIPYNPFFYSYTLLTDSSIRLFANKSRFSSETLSYLNSSCTGPMCVQIEDYSQVRDSIQAYSLGDVRIWIGTSYTMYGIYEMIPKEKLVTDTYSPVMMTKAVKNSKEQALLKASHVRDAVAVIRYLVWLEKNVPKGTVDEFSGAEIVDKFRGEEQFSSGPSFETISASGLNAALAHYSPTKELNRKLSSDEMYLLDSGGQYWDGTTDITRTVHWGTPSAFQKEAYTRVLIGNIDLSRLIFPAATSGRMVEAFARRALWDAGLNYGHGTGHGIGNFLCVHEWPVGFQSNNIAMAKGMFTSIEPGYYKDGEFGIRLEDVALVVEAKTKYPGSYLTFEVVSFVPYDRNLIDVSLLSPEHLQYLNRYYQTIREKVGPELQRRQLLEEFEWLQQHTEPLAARAPDTASWASVLVVSTLAILGWSV

SEQ ID NO: 14359 - protein, 183 aa, Homo Sapiens
MARAHWGCCPWLVLLCACAWGHTKPVDLGGQDVRNCSTNPPYLPVTVVNTTMSLTALRQQMQTQNLSAYIIPGTDAHMNEYIGQHDERRAWITGFTGSAGTAVVTMKKAAVWTDSRYWTQAERQMDCNWELHKEVGTTPIVTWLLTEIPAGGRVGFDPFLLSIGMLFLQSLNLSMLTRVTQLP

SEQ ID NO: 14360 - protein, 393 aa, Homo Sapiens
MGLLRGGLPCARAMARLGAVRSHYCALLLAAALAVCAFYYLGSGRETFSSATKRLKEARAGAPAAPSPPALELARGSVAPAPGAKAKSLEGGGAGPVDYHLLMMFTKAEHNAALQAKARVALRSLLRLAKFEAHEVLNLHFVSEEASREVAKGLLRELLPPAAGFKCKVIFHDVAVLTDKLFPIVEAMQKHFSAGLGTYYSDSIFFLSVAMHQIMPKEILQIIQLDLDLKFKTNIRELFEEFDSFLPGAIIGIAREMQPVYRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 14361 - protein, 187 aa, Homo Sapiens
MNGMSVLMKETLKSSVTPSPYEETGERQPSVNWAVSPHQTQNQWARWSWTSQPLELHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 14362 - protein, 84 aa, Homo Sapiens
MVRCVPSAVIVCFLRPPQPGRTVIFHDVAVLTDKLFPIVEAMQKHFSAGLGTYYSDSIFFLSVAMHQIMPKECTPLVQGRTSCT

SEQ ID NO: 14363 - protein, 247 aa, Homo Sapiens
MVRCVPSAVIVCFLRPPQPGRTVIFHDVAVLTDKLFPIVEAMQKHFSAGLGTYYSDSIFFLSVAMHQIMPKEILQIIQLDLDLKFKTNIRELFEEFDSFLPGAIIGIAREMQPVYRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 14364 - protein, 190 aa, Homo Sapiens
MWPPRCKDPGRQSAEILQIIQLDLDLKFKTNIRELFEEFDSFLPGAIIGIAREMQPVYRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 14365 - protein, 114 aa, Homo Sapiens
  misc_feature (1)..(1): Xaa can be any naturally occurring amino acid
XSPPALELARGSVAPAPGAKAKSLEGGGAGPVDYHLLMMFTKAEHNAALQAKARVALRSLLRLAKFEAHEVLNLHFVSEEASREVAKGLLRELLPPAAGFKCKFLTSEDGTGHQ

SEQ ID NO: 14366 - protein, 959 aa, Homo Sapiens
MVAAPCARRLARRSHSALLAALTVLLLQTLVVWNFSSLDSGAGERRGGAAVGGGEQPPPAPAPRRERRDLPAEPAAARGGGGGGGGGGGGRGPQARARGGGPGEPRGQQPASRGALPARALDPHPSPLITLETQDGYFSHRPKEKVRTDSNNENSVPKDFENVDNSNFAPRTQKQKHQPELAKKPPSRQKELLKRKLEQQEKGKGHTFPGKGPGEVLPPGDRAAANSSHGKDVSRPPHARKTGGSSPETKYDQPPKCDISGKEAISALSRAKSKHCRQEIGETYCRHKLGLLMPEKVTRFCPLEGKANKNVQWDEDSVEYMPANPVRIAFVLVVHGRASRQLQRMFKAIYHKDHFYYIHVDKRSNYLHRQVLQVSRQYSNVRVTPWRMATIWGGASLLSTYLQSMRDLLEMTDWPWDFFINLSAADYPIRTNDQLVAFLSRYRDMNFLKSHGRDNARFIRKQGLDRLFLECDAHMWRLGDRRIPEGIAVDGGSDWFLLNRRFVEYVTFSTDDLVTKMKQFYSYTLLPAESFFHTVLENSPHCDTMVDNNLRITNWNRKLGCKCQYKHIVDWCGCSPNDFKPQDFHRFQQTARPTFFARKFEAVVNQEIIGQLDYYLYGNYPAGTPGLRSYWENVYDEPDGIHSLSDVTLTLYHSFARLGLRRAETSLHTDGENSCRYYPMGHPASVHLYFLADRFQGFLIKHHATNLAVSKLETLETWVMPKKVFKIASPPSDFGRLQFSEVGTDWDAKERLFRNFGGLLGPMDEPVGMQKWGKGPNVTVTVIWVDPVNVIAATYDILIESTAEFTHYKPPLNLPLRPGVWTVKILHHWVPVAETKFLVAPLTFSNRQPIKPEEALKLHNGPLRNAYMEQSFQSLNPVLSLPINPAQVEQARRNAASTGTALEGWLDSLVGGMWTAMDICATGPTACPVMQTCSQTAWSSFSPDPKSELGAVKPDGRLR

SEQ ID NO: 14367 - protein, 117 aa, Homo Sapiens
CQYKHIVDWCGCSPNDFKPQDFLRLQQVSRPTFFARKFESTVNQEVLEILDFHLYGSYPPGTPALKAYWENTYDAADGPSGLSDVMLTAYTAFARLSLHHAATAAPPMGTPLCRATW

SEQ ID NO: 14368 - protein, 46 aa, Homo Sapiens
ETLEMWLMPQGSLKLLGRSDQASRLQSLEVGQVPHLLSPNPHPDLG

SEQ ID NO: 14369 - protein, 45 aa, Homo Sapiens
MVASARVQKLVRRYKLAIATALAILLLQGLKGRQRKPRPLDPGEG

SEQ ID NO: 14370 - protein, 865 aa, Homo Sapiens [sequence omitted]

SEQ ID NO: 14371 - protein, 639 aa, Homo Sapiens
MVASARVQKLVRRYKLAIATALAILLLQGLVVWSFSGLEEDEAGEKGRQRKPRPLDPGEGSKDTDSSAGRRGSTGRRHGRWRGRAESPGVPVAKVVRAVTSRQRASRRVPPAPPPEAPGRQNLSGAAAGEALVGAAGFPPHGDTGSVEGAPQPTDNGFTPKCEIVGKDALSALARASTKQCQQEIANVVCLHQAGSLMPKAVPRHCQLTGKMSPGIQWDESQAQQPMDGPPVRIAYMLVVHGRAIRQLKRLLKAVYHEQHFFYIHVDKRSDYLHREVVELAQGYDNVRVTPWRMVTIWGGASLLRMYLRSMRDLLEVPGWAWDFFINLSATDYPTRTNEELVAFLSKNRDKNFLKSHGRDNSRFIKKQGLDRLFHECDSHMWRLGERQIPAGIVVDGGSDWFVLTRSFVEYVVYTDDPLVAQLRQFYTYTLLPAESFFHTVLENSLACETLVDNNLRVTNWNRKLGCKCQYKHIVDWCGCSPNDFKPQDFLRLQQVSRPTFFARKFESTVNQEVLEILDFHLYGSYPPGTPALKAYWENTYDAADGPSGLSDVMLTAYTAFARLSLHHAATAAPPMGTPLCRLALIGTPKSVFSGTLGGYWGRWTSLWPCSAGPGAPTSQPQWSGSTQPMWWPHLMTSQ

SEQ ID NO: 14372 - protein, 676 aa, Homo Sapiens
MVASARVQKLVRRYKLAIATALAILLLQGLVVWSFSGLEEDEAGEKGRQRKPRPLDPGEGSKDTDSSAGRRGSTGRRHGRWRGRAESPGVPVAKVVRAVTSRQRASRRVPPAPPPEAPGRQNLSGAAAGEALVGAAGFPPHGDTGSVEGAPQPTDNGFTPKCEIVGKDALSALARASTKQCQQEIANVVCLHQAGSLMPKAVPRHCQLTGKMSPGIQWDESQAQQPMDGPPVRIAYMLVVHGRAIRQLKRLLKAVYHEQHFFYIHVDKRSDYLHREVVELAQGYDNVRVTPWRMVTIWGGASLLRMYLRSMRDLLEVPGWAWDFFINLSATDYPTRTNEELVAFLSKNRDKNFLKSHGRDNSRFIKKQGLDRLFHECDSHMWRLGERQIPAGIVVDGGSDWFVLTRSFVEYVVYTDDPLVAQLRQFYTYTLLPAESFFHTVLENSLACETLVDNNLRVTNWNRKLGCKCQYKHIVDWCGCSPNDFKPQDFLRLQQVSRPTFFARKFESTVNQEVLEILDFHLYGSYPPGTPALKAYWENTYDAADGPSGLSDVMLTAYTAFARLSLHHAATAAPPMGTPLCRFEPRGLPSSVHLYFYDDHFQGYLVTQAVQPSAQGPAETLEMWLMPQGSLKLLGRSDQASRLQSLENRGLSMLPRLVSNSWPQAVLPLQPPKALG

SEQ ID NO: 14373 - protein, 252 aa, Homo Sapiens
MSSEVSARRDAKKLVRSPSGLRMVPEHRAFGSPFGLEEPQWVPDKECRRCMQCDAKFDFLTRKHHCRRCGKCFCDRCCSQKVPLRRMCFVDPVRQCAECALVSLKEAEFYDKQLKVLLSGATFLVTFGNSEKPETMTCRLSNNQRYLFLDGDSHYEIEIVHISTVQILTEGFPPGEKDIHAYTSLRGSQPASEGGNARATGMFLQYTVPGTEGVTQLKLTVVEDVTVGRRQAVAWLVAMHKAAKLLYESRDQ

SEQ ID NO: 14374 - protein, 234 aa, Homo Sapiens
MSSEVSARRDAKKLVRSPSGLRMVPEHRAFGSPFGLEEPQWVPDKECRRCMQCDAKFDFLTRKHHCRRCGKCFCDRCCSQKVPLRRMCFVDPVRQCAECALVSLKEAEFYDKQLKVLLSGATFLVTFGNSEKPETMTCRLSNNQRYLFLDGDSHYEIEIVHISTVQILTEGFPPGGGNARATGMFLQYTVPGTEGVTQLKLTVVEDVTVGRRQAVAWLVAMHKAAKLLYESRDQ

SEQ ID NO: 14375 - protein, 93 aa, Homo Sapiens
MSSEVSARRDAKKLVRSPSGLRMVPEHRAFGSPFGLEEPQWVPDKECRRCMQCDAKFDFLTRKVRRIPAAWWGAQGLATGGARVQRPAQGPRV

SEQ ID NO: 14376 - protein, 62 aa, Homo Sapiens
MSSEVSARRDAKKLVRSPSGLRMVPEHRAFGSPFGLEEPQWVPDKEEPPSSSRLETQRNLKL

SEQ ID NO: 14377 - protein, 115 aa, Homo Sapiens
  misc_feature (1)..(1): Xaa can be any naturally occurring amino acid
XKVLLSGATFLVTFGNSEKPETMTCRLSNNQRYLFLDGDSHYEIEIVHISTVQILTEGFPPGEKDIHAYTSLRGSQPASEGQPLPPHRGSPHAAGPFLPSPPGFCPRGGPCQGSL

SEQ ID NO: 14378 - protein, 167 aa, Homo Sapiens
MLTVALLALLCASASGNAIQARSSSYSGEYGGGGGKRFSHSGNQLDGPITALRVRVNTYYIVGLQVRYGKVWSDYVGGRNGDLEEIFLHPGESVIQVSGKYKWYLKKLVFVTDKGRYLSFGKDSGTSFNAVPLHPNTVLRFISGRSGSLIDAIGLHWDVYPSSCSRC

SEQ ID NO: 14379 - protein, 208 aa, Homo Sapiens
MGAQGAQESIKAMWRVPGTTRRPVTGESPGMHRPEAMLLLLTLALLGGPTWAGKMYGPGGGKYFSTTEDYDHEITGLRVSVGLLLVKSVQVKLGDSWDVKLGALGGNTQEVTLQPGEYITKVFVAFQAFLRGMVMYTSKDRYFYFGKLDGQISSAYPSQEGQVLVGIYGQYQLLGIKSIGFEWNYPLEEPTTEPPVNLTYSANSPVGR

SEQ ID NO: 14380 - protein, 178 aa, Homo Sapiens
MHRPEAMLLLLTLALLGGPTWAGKMYGPGGGKYFSTTEDYDHEITGLRVSVGLLLVKSVQVKLGDSWDVKLGALGGNTQEVTLQPGEYITKVFVAFQAFLRGMVMYTSKDRYFYFGKLDGQISSAYPSQEGQVLVGIYGQYQLLGIKSIGFEWNYPLEEPTTEPPVNLTYSANSPVGR

SEQ ID NO: 14381 - protein, 95 aa, Homo Sapiens
  misc_feature (1)..(1): Xaa can be any naturally occurring amino acid
XAQGAQESIKAMWRVPGTTRRPVTGESPGMHRPEAMLLLLTLALLGGPTWAGKMYGPGGGKYFSTTEDYDHEITGLRVSVGLLLVKRFLEGVIYE

SEQ ID NO: 14382 - protein, 69 aa, Homo Sapiens
  misc_feature (1)..(1): Xaa can be any naturally occurring amino acid
XRRPVTGESPGMHRPEAMLLLLTLALLGGPTWAGKMYGPGGGKYFSTTEDYDHEITGLRVSVGLLLVKR

SEQ ID NO: 14383 - protein, 372 aa, Homo Sapiens
MNGPCQSLRKAEGLLEGCTSAVTVFRKLPLDSKAQSQKMRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 14384 - protein, 384 aa, Homo Sapiens
MPPFCRNAKLGLLSFLICAGRSLLPLGKNAFWLERIENNNTLWEKAQSQKMRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 14385 - protein, 128 aa, Homo Sapiens
MRYKTSLVMRKRLRLYRNTLKESSEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 14386 - protein, 68 aa, Homo Sapiens
MRYKTSLVMRKRLRLYRNTLKESSSSSGHHGPQLTAASSPSVFPGLHEEPPQASPSRPLNGLLRLGLP

SEQ ID NO: 14387 - protein, 77 aa, Homo Sapiens
MRYKTSLVMRKRLRLYRNTLKESSSSSGHHGPQLTAASSPSVFPGLHEEPPQASPSRPLNGLLRLGLPGDMYARPEP

SEQ ID NO: 14388 - protein, 229 aa, Homo Sapiens
MRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHT

SEQ ID NO: 14389 - protein, 334 aa, Homo Sapiens
MRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 14390 - protein, 334 aa, Homo Sapiens; identical to SEQ ID NO: 14389

SEQ ID NO: 14391 - protein, 334 aa, Homo Sapiens; identical to SEQ ID NO: 14389

SEQ ID NO: 14392 - protein, 497 aa, Homo Sapiens
MAMSSLGCLCALTVLIRYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 14393 - protein, 494 aa, Homo Sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 14394 - protein, 463 aa, Homo Sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 14395 - protein, 493 aa, Homo Sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQALP

SEQ ID NO: 14396 - protein, 478 aa, Homo Sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 14397 - protein, 46 aa, Homo Sapiens
MQVHKETIDAVPNAIPGRTDIELEIYGMEGIPEKDMDERRRLLEQK

SEQ ID NO: 14398 - protein, 74 aa, Homo Sapiens
MQVHKETIDAVPNAIPGRTDIELEIYGMEGIPEKDMDERRRLLEQKTQESQKKKQQDDSDEYDDDDSAASTSFQ

SEQ ID NO: 14399 - protein, 93 aa, Homo Sapiens
MQVHKETIDAVPNAIPGRTDIELEIYGMEGIPEKDMDERRRLLEQKTQESQKKKQQDDSDEYDDDDSAASTSFQPQPVQPQQGYIPPMAQPGL

SEQ ID NO: 14400 - protein, 96 aa, Homo Sapiens
MQVHKETIDAVPNAIPGRTDIELEIYGMEGIPEKDMDERRRLLEQKTQESQKKKQQDDSDEYDDDDSAASTSFQPQPVQPQQGYIPPMAQPGLPPV

SEQ ID NO: 14401 - protein, 198 aa, Homo Sapiens
MQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRP

SEQ ID NO: 14402 - protein, 341 aa, Homo Sapiens
  misc_feature (1)..(1): Xaa can be any naturally occurring amino acid
XGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 14403 - protein, 80 aa, Homo Sapiens
MATSFRTASCWGLLSFKDISMEFTWDEWQLLDSTQKYLYRDVILENYHNLISVDGWEEWYQNNQDELESIERSYACSVLG

SEQ ID NO: 14404 - protein, 533 aa, Homo Sapiens
MATSFRTASCWGLLSFKDISMEFTWDEWQLLDSTQKYLYRDVILENYHNLISVGYHGTKPDLIFKLEQGEDPWIINAKISRQSCPDGWEEWYQNNQDELESIERSYACSVLGRLNLSKTHDSSRQRLYNTRGKSLTQNSAPSRSYLRKNPDKFHGYEEPYFLKHQRAHSIEKNCVCSECGKAFRCKSQLIVHLRIHTGERPYECSKCERAFSAKSNLNAHQRVHTGEKPYSCSECEKVFSFRSQLIVHQEIHTGGKPYGCSECGKAYSWKSQLLLHQRSHTGVKPYECSECGKAFSLKSPFVVHQRTHTGVKPHKCSECGKAFRSKSYLLVHIRMHTGEKPYQCSDCGKAFNMKTQLIVHQGVHTGNNPYQCGECGKAFGRKEQLTAHLRAHAGEKPYGCSECGKAFSSKSYLVIHRRTHTGERPYECSLCERAFCGKSQLIIHQRTHSTEKPYECNECEKAYPRKASLQIHQKTHSGEKPFKCSECGKAFTQKSSLSEHQRVHTGEKPWKCSECGKSFCWNSGLRIHRKTHK

SEQ ID NO: 14405 - protein, 153 aa, Homo Sapiens
MATSFRTASCWVVLLRRSLLMSSSVKFGNLLGVPWAQGNSALPEGLLSFKDISMEFTWDEWQLLDSTQKYLYRDVILENYHNLISVGYHGTKPDLIFKLEQGEDPWIINAKISRQSCPDGWEEWYQNNQDELESIERSYACSVLGRLNLSKTH

SEQ ID NO: 14406 - protein, 513 aa, Homo Sapiens
MEFTWDEWQLLDSTQKYLYRDVILENYHNLISVGYHGTKPDLIFKLEQGEDPWIINAKISRQSCPDGWEEWYQNNQDELESIERSYACSVLGRLNLSKTHDSSRQRLYNTRGKSLTQNSAPSRSYLRKNPDKFHGYEEPYFLKHQRAHSIEKNCVCSECGKAFRCKSQLIVHLRIHTGERPYECSKCERAFSAKSNLNAHQRVHTGEKPYSCSECEKVFSFRSQLIVHQEIHTGGKPYGCSECGKAYSWKSQLLLHQRSHTGVKPYECSECGKAFSLKSPFVVHQRTHTGVKPHKCSECGKAFRSKSYLLVHIRMHTGEKPYQCSDCGKAFNMKTQLIVHQGVHTGNNPYQCGECGKAFGRKEQLTAHLRAHAGEKPYGCSECGKAFSSKSYLVIHRRTHTGERPYECSLCERAFCGKSQLIIHQRTHSTEKPYECNECEKAYPRKASLQIHQKTHSGEKPFKCSECGKAFTQKSSLSEHQRVHTGEKPWKCSECGKSFCWNSGLRIHRKTHK

SEQ ID NO: 14407 - protein, 264 aa, Homo Sapiens
MAALFLSAPPQAEVTFEDVAVYLSREEWGRLGPAQRGLYRDVMLETYGNLVSLALGTRTEYKELTSQETFGEEDPQGSEPVEACDHISKSEGSLEKLVEQRGPRAVTLTNGESSRESGGNLRLLSRPVPDQRPHKCDICEQSFEQRSYLNNHKRVHRSKKTNTVRNSGEIFSANLVVKEDQKIPTGKKLHYCSYCGKTFRYSANLVKHQRLHTEEKPYKCDECGKAFSQSCEFINHRRMHSGEIPYRCDECGKTFTRRPNLMKH

SEQ ID NO: 14408 - protein, 539 aa, Homo Sapiens
MAALFLSAPPQAEVTFEDVAVYLSREEWGRLGPAQRGLYRDVMLETYGNLVSLGVGPAGPKPGVISQLERGDEPWVLDVQGTSGKEHLRVNSPALGTRTEYKELTSQETFGEEDPQGSEPVEACDHISKSEGSLEKLVEQRGPRAVTLTNGESSRESGGNLRLLSRPVPDQRPHKCDICEQSFEQRSYLNNHKRVHRSKKTNTVRNSGEIFSANLVVKEDQKIPTGKKLHYCSYCGKTFRYSANLVKHQRLHTEEKPYKCDECGKAFSQSCEFINHRRMHSGEIPYRCDECGKTFTRRPNLMKHQRIHTGEKPYKCGECGKHFSAYSSLIYHQRIHTGEKPYKCNDCGKAFSDGSILIRHRRTHTGEKPFECKECGKGFTQSSNLIQHQRIHTGEKPYKCNECEKAFIQKTKLVEHQRSHTGEKPYECNDCGKVFSQSTHLIQHQRIHTGEKPYKCSECGKAFHNSSRLIHHQRLHHGEKPYRCSDCKKAFSQSTYLIQHRRIHTGEKPYKCSECGKAFRHSSNMCQHQRIHLREDFSM

SEQ ID NO: 14409 - protein, 158 aa, Homo Sapiens
MLLLLSDQLLLTALRKPNPQAMAALFLSAPPQAEVTFEDVAVYLSREEWGRLGPAQRGLYRDVMLETYGNLVSLALGTRTEYKELTSQETFGEEDPQGSEPVEACDHISKSEGSLEKLVEQRGPRAVTLTNGESSRESGGNLRLLSRPVPDQRPHKCD

SEQ ID NO: 14410 - protein, 560 aa, Homo Sapiens
MLLLLSDQLLLTALRKPNPQAMAALFLSAPPQAEVTFEDVAVYLSREEWGRLGPAQRGLYRDVMLETYGNLVSLGVGPAGPKPGVISQLERGDEPWVLDVQGTSGKEHLRVNSPALGTRTEYKELTSQETFGEEDPQGSEPVEACDHISKSEGSLEKLVEQRGPRAVTLTNGESSRESGGNLRLLSRPVPDQRPHKCDICEQSFEQRSYLNNHKRVHRSKKTNTVRNSGEIFSANLVVKEDQKIPTGKKLHYCSYCGKTFRYSANLVKHQRLHTEEKPYKCDECGKAFSQSCEFINHRRMHSGEIPYRCDECGKTFTRRPNLMKHQRIHTGEKPYKCGECGKHFSAYSSLIYHQRIHTGEKPYKCNDCGKAFSDGSILIRHRRTHTGEKPFECKECGKGFTQSSNLIQHQRIHTGEKPYKCNECEKAFIQKTKLVEHQRSHTGEKPYECNDCGKVFSQSTHLIQHQRIHTGEKPYKCSECGKAFHNSSRLIHHQRLHHGEKPYRCSDCKKAFSQSTYLIQHRRIHTGEKPYKCSECGKAFRHSSNMCQHQRIHLREDFSM

SEQ ID NO: 14411 - protein, 464 aa, Homo Sapiens
MAAAALRDPAQGYVTFEDVAVYFSQEEWRLLDDAQRLLYRNVMLENFTLLASLGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 14412 - protein, 113 aa, Homo Sapiens
MAAAALRDPAQGYVTFEDVAVYFSQEEWRLLDDAQRLLYRNVMLENFTLLASLGKVLTPHPSILSWARLFLLFLGRGLFFPKLNCGHSFLLQYPEVAIVIGLGCVYYHLLSPS

SEQ ID NO: 14413 - protein, 497 aa, Homo Sapiens
MAAAALRDPAQGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 14414 - protein, 121 aa, Homo Sapiens
MAAAALRDPAQQGYVTFEDVAVYFSQEEWRLLDDAQRLLYRNVMLENFTLLASLGCWHGAEAEEAPEQIASVGLLSSNIQQHQKQHCGEKPLKRQEGRVPVLRSCKVHLSEKSLQSREVGK

SEQ ID NO: 14415 - protein, 442 aa, Homo Sapiens
MAAAALRDPAQQGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSSLVKHQRVHTGAKPYECRECGKFFRHNSSLFKHRRIHTGEMQ

SEQ ID NO: 14416 - protein, 498 aa, Homo Sapiens
MAAAALRDPAQQGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 14417 - protein, 97 aa, Homo Sapiens
MAAAALRDPAQQGYVTFEDVAVYFSQEEWRLLDDAQRLLYRNVMLENFTLLASLGLASSKTHEITQLESWEEPFMPAWEVVTSAIPRGSWWVELREV

SEQ ID NO: 14418 - protein, 173 aa, Homo Sapiens
MAAAALRDPAQVPVAADLLTDHEEGYVTFEDVAVYFSQEEWRLLDDAQRLLYRNVMLENFTLLASLGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCS

SEQ ID NO: 14419 - protein, 87 aa, Homo Sapiens
MAAAALRDPAQVPVAADLLTDHEEGYVTFEDVAVYFSQEEWRLLDDAQRLLYRNVMLENFTLLASLGKVLTPHPSILSWARLFLLFL

SEQ ID NO: 14420 - protein, 510 aa, Homo Sapiens
MAAAALRDPAQVPVAADLLTDHEEGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 14421 - protein, 478 aa, Homo Sapiens
MAAAALRDPAQVPVAADLLTDHEEQGYVTFEDVAVYFSQEEWRLLDDAQRLLYRNVMLENFTLLASLGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 14422 - protein, 115 aa, Homo Sapiens [sequence omitted]

SEQ ID NO: 14423 - protein, 511 aa, Homo Sapiens
MAAAALRDPAQVPVAADLLTDHEEQGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQEGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRIHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 14424 - protein, 110 aa, Homo Sapiens
MAAAALRDPAQVPVAADLLTDHEEQGYVTFEDVAVYFSQEEWRLLDDAQRLLYRNVMLENFTLLASLGLASSKTHEITQLESWEEPFMPAWEVVTSAIPRGSWWVELREV

SEQ ID NO: 14425 - protein, 50 aa, Homo Sapiens
MLENFTLLASLGCWHGAEAEEAPEQIASVGLLSSNIQQHQKQHCGEKPLK

SEQ ID NO: 14426 - protein, 77 aa, Homo Sapiens
MASFGASLWPDLGACSQHLSLYHSVTVELAASTARHPASSLQEDSVAFEDVAVTFTQEEWALLDPSQKNLCRDVMQE

SEQ ID NO: 14427 - protein, 207 aa, Homo Sapiens
MDSVAFEDVAVTFTQEEWALLDPSQKNLCRDVMQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCLSSVQTHERAHSGRKLYVCEECGKTFISHSNLQRHRIMHRGDGPYKCKFCGKALMFL

SEQ ID NO: 14428 - protein, 77 aa, Homo Sapiens
MFQDSVAFEDVAVTFTQEEWALLDPSQKNLCRDVMQETFRNLASIGKKWKPQNIYVEYENLRRNLRIVGERLFESKE

SEQ ID NO: 14429 - protein, 41 aa, Homo Sapiens
MGDRNCRENHASMPGKVSGSLEVMKSMFKVLTDLVPGFSGL

SEQ ID NO: 14430 - protein, 117 aa, Homo Sapiens
MLVLSILLYTCEMFQDSVAFEDVAVTFTQEEWALLDPSQKNLCRDVMQETFRNLASIGKKWKPQNIYVEYENLRRNLRIVGERLFESKEGHQHGEILTQVPDDMLKKTTTGVKSCES

SEQ ID NO: 14431 - protein, 166 aa, Homo Sapiens
MLVLSILLYTCEMFQDSVAFEDVAVTFTQEEWALLDPSQKNLCRDVMQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCLS

SEQ ID NO: 14432 - protein, 673 aa, Homo Sapiens
MMFQDSVAFEDVAVTFTQEEWALLDPSQKNLCRDVMQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCLSSVQTHERAHSGRKLYVCEECGKTFISHSNLQRHRIMHRGDGPYKCKFCGKALMFLSLYLIHKRTHTGEKPYQCKQCGKAFSHSSSLRIHERTHTGEKPYKCNECGKAFHSSTCLHAHKRTHTGEKPYECKQCGKAFSSSHSFQIHERTHTGEKPYECKECGKAFKCPSSVRRHERTHSRKKPYECKHCGKVLSYLTSFQNHLGMHTGEISHKCKICGKAFYSPSSLQTHEKTHTGEKPYKCNQCGKAFNSSSSFRYHERTHTGEKPYECKQCGKAFRSASLLQTHGRTHTGEKPYACKECGKPFSNFSFFQIHERMHREEKPYECKGYGKTFSLPSLFHRHERTHTGGKTYECKQCGRSFNCSSSFRYHGRTHTGEKPYECKQCGKAFRSASQLQIHGRTHTGEKPYECKQCGKAFGSASHLQMHGRTHTGEKPYECKQCGKSFGCASRLQMHGRTHTGEKPYKCKQCGKAFGCPSNLRRHGRTHTGEKPYKCNQCGKVFRCSSQLQVHGRAHCIDTP

SEQ ID NO: 14433 - protein, 52 aa, Homo Sapiens
MQETFRNLASIGKKWKPQNIYVEYENLRRNLRIVGERLFESKEGHQHGEILT

SEQ ID NO: 14434 - protein, 119 aa, Homo Sapiens
MQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCL

SEQ ID NO: 14435 - protein, 638 aa, Homo Sapiens
MQETFRNLASIGKKWKPQNIYVEYENLRRNLRIVGERLFESKEGHQHGEILTQVPDDMLKKTTTGVKSCESSVYGEVGSAHSSLNRHIRDDTGHKAYEYQEYGQKPYKCKYCKKPFNCLSSVQTHERAHSGRKLYVCEECGKTFISHSNLQRHRIMHRGDGPYKCKFCGKALMFLSLYLIHKRTHTGEKPYQCKQCGKAFSHSSSLRIHERTHTGEKPYKCNECGKAFHSSTCLHAHKRTHTGEKPYECKQCGKAFSSSHSFQIHERTHTGEKPYECKECGKAFKCPSSVRRHERTHSRKKPYECKHCGKVLSYLTSFQNHLGMHTGEISHKCKICGKAFYSPSSLQTHEKTHTGEKPYKCNQCGKAFNSSSSFRYHERTHTGEKPYECKQCGKAFRSASLLQTHGRTHTGEKPYACKECGKPFSNFSFFQIHERMHREEKPYECKGYGKTFSLPSLFHRHERTHTGGKTYECKQCGRSFNCSSSFRYHGRTHTGEKPYECKQCGKAFRSASQLQIHGRTHTGEKPYECKQCGKAFGSASHLQMHGRTHTGEKPYECKQCGKSFGCASRLQMHGRTHTGEKPYKCKQCGKAFGCPSNLRRHGRTHTGEKPYKCNQCGKVFRCSSQLQVHGRAHCIDTP

SEQ ID NO: 14436 - protein, 518 aa, Homo Sapiens
MAVALGCAIQASLNQGSVFQEYDTDCEVFRQRFRQFQYREAAGPHEAFNKLWELCCQWLKPKMRSKEQILELLVLEQFLTILPTEIETWVREHCPENRERVVSLIEDLQRELEIPEQQVDMHDMLLEELAPVGTAHIPPTMHLESPALQVMGPAQEAPVAEAWIPQAGPPELNYGATGECQNFLDPGYPLPKLDMNFSLENREEPWVKELQDSKEMKQLLDSKIGFEIGIENEEDTSKQKKMETMYPFIVTLEGNALQGPILQKDYVQLENQWETPPEDLQTDLAKLVDQQNPTLGETPENSNLEEPLNPKPHKKKSPGEKPHRCPQCGKCFARKSQLTGHQRIHSGEEPHKCPECGKRFLRSSDLYRHQRLHTGERPYECTVCKKRFTRRSHLIGHQRTHSEEETYKCLECGKSFCHGSSLKRHLKTHTGEKPHRCHNCGKSFSRLTALTLHQRTHTEERPFKCNYCGKSFRQRPSLVIHLRIHTGEKPYKCTHCSKSFRQRAGLIMHQVTHFRGLI

SEQ ID NO: 14437 - protein, 164 aa, Homo Sapiens
MAVALGCAIQASLNQGSVFQEYDTDCEVFRQRFRQFQYREAAGPHEAFNKLWELCCQWLKPKMRSKEQILELLVLEQFLTILPTEIETWVREHCPENRERVVSLIEDLQRELEIPEQQVRKECGIFVIGPKEVAEAAGTRPHICLYVIPQPQDFSRVLFLFLFC

SEQ ID NO: 14438 - protein, 233 aa, Homo Sapiens
MKDRQVDAQAQEREHDDPTGQPGAPQLTQNIPRGPAGSKVFSVWPSGARSEQRSAFSKPTKRPAERPELTSVFPAGESADALGELSGLLNTTDLACWGRLSTPKLLVGDLWNLQALPQNAPLCSTFLGAPTLWLEHTQAQVPPPSSSSTTSWALLPPTLTSLGLSTQNWCAKCNLSFRLTSDLVFHMRSHHKKEHAGPDPHSQKRREEALACPVCQEHFRERHHLSRHMTSHS

SEQ ID NO: 14439 - protein, 340 aa, Homo Sapiens
MPEWPPCLSVAPALVITMAAGKGAPLSPSAENRWRLSEPELGRGCKPVLLEKTNRLGPEAAVGRAGRDVGSAELALLVAPGKPRPGKPLPPKTRGEQRQSAFTELPRMKDRQVDAQAQEREHDDPTGQPGAPQLTQNIPRGPAGSKVFSVWPSGARSEQRSAFSKPTKRPAERPELTSVFPAGESADALGELSGLLNTTDLACWGRLSTPKLLVGDLWNLQALPQNAPLCSTFLGAPTLWLEHTQAQVPPPSSSSTTSWALLPPTLTSLGLSTQNWCAKCNLSFRLTSDLVFHMRSHHKKEHAGPDPHSQKRREEALACPVCQEHFRERHHLSRHMTSHS

SEQ ID NO: 14440 - protein, 252 aa, Homo Sapiens
MQLPPALCARLAAGPGAAEPLPVERDPAAGAAPFRFVARPVRFPREHQFFEDGDVQRHLYLQDVIMQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMVRMHLYPADFRFDKPKKSRSPASAEAPGDSGERSEGEAMEICSEPVAASPAPAGERRIYRHRIPSTICFGQGAARGFKSNKKKTKQC

SEQ ID NO: 14441 - protein, 262 aa, Homo Sapiens
MQLPPALCARLAAGPGAAEPLPVERDPAAGAAPFRFVARPVRFPREHQFFEDGDVQRHLYLQDVIMQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMVRMHLYPADFRFDKPKKSRSPASAEAPGDSGERSEGEAMEICSEPVAASPAPAGERRIYRHRSVSELFLKPVLNMCSVLRILGCTWAAALLILNSER

SEQ ID NO: 14442 - protein, 86 aa, Homo Sapiens
MAVGLLKAMYQELVTFRDVAVDFSQEEWDCLDSSQRHLYSNVMLENYRILVSLGLCFSKPSVILLLEQGKAPWMVKRELTKGLCSG

SEQ ID NO: 14443 - protein, 148 aa, Homo Sapiens
MAVGLLKAMYQELVTFRDVAVDFSQEEWDCLDSSQRHLYSNVMLENYRILVSLGLCFSKPSVILLLEQGKAPWMVKRELTKGLCSGWEPICETEELTPKQDFYEEHQSQKIIETLTSYNLEYSSLREEWKCEGYFERQPGNQKACFKE

SEQ ID NO: 14444 - protein, 536 aa, Homo Sapiens
MAVGLLKAMYQELVTFRDVAVDFSQEEWDCLDSSQRHLYSNVMLENYRILVSLGLCFSKPSVILLLEQGKAPWMVKRELTKGLCSGWEPICETEELTPKQDFYEEHQSQKIIETLTSYNLEYSSLREEWKCEGYFERQPGNQKACFKEEIITHEEPLFDEREQEYKSWGSFHQNPLLCTQKIIPKEEKVHKHDTQKRSFKKNLMAIKPKSVCAEKKLLKCNDCEKVFSQSSSLTLHQRIHTGEKPYKCIECGKAFSQRSNLVQHQRIHTGEKPYECKECRKAFSQNAHLVQHLRVHTGEKPYECKVCRKAFSQFAYLAQHQRVHTGEKPYECIECGKAFSNRSSIAQHQRVHTGEKPYECNVCGKAFSLRAYLTVHQRIHTGERPYECKECGKAFSQNSHLAQHQRIHTGEKPYKCQECRKAFSQIAYLAQHQRVHTGEKPYECIECGKAFSNDSSLTQHQRVHTGEKPYECTVCGKAFSYCGSLAQHQRIHTGERPYECKECKKTFRQHAHLAHHQRIHIGESLSPPNPVNHQVL

SEQ ID NO: 14445 - protein, 592 aa, Homo Sapiens
MCMYLFFLDFSIVGSGLRSGVWVSGSSSQAICVTPVRVESSEATAISQEKSQEEERMAVGLLKAMYQELVTFRDVAVDFSQEEWDCLDSSQRHLYSNVMLENYRILVSLGLCFSKPSVILLLEQGKAPWMVKRELTKGLCSGWEPICETEELTPKQDFYEEHQSQKIIETLTSYNLEYSSLREEWKCEGYFERQPGNQKACFKEEIITHEEPLFDEREQEYKSWGSFHQNPLLCTQKIIPKEEKVHKHDTQKRSFKKNLMAIKPKSVCAEKKLLKCNDCEKVFSQSSSLTLHQRIHTGEKPYKCIECGKAFSQRSNLVQHQRIHTGEKPYECKECRKAFSQNAHLVQHLRVHTGEKPYECKVCRKAFSQFAYLAQHQRVHTGEKPYECIECGKAFSNRSSIAQHQRVHTGEKPYECNVCGKAFSLRAYLTVHQRIHTGERPYECKECGKAFSQNSHLAQHQRIHTGEKPYKCQECRKAFSQIAYLAQHQRVHTGEKPYECIECGKAFSNDSSLTQHQRVHTGEKPYECTVCGKAFSYCGSLAQHQRIHTGERPYECKECKKTFRQHAHLAHHQRIHIGESLSPPNPVNHQVL

SEQ ID NO: 14446 - protein, 44 aa, Homo Sapiens
MCMYLFFLDFSIVSVTVLLDFMTRDRERKVVWPDRLTSKQTWPY

SEQ ID NO: 14447 - protein, 44 aa, Homo Sapiens
MLENYRILVSLGLCFSKPSVILLLEQGKAPWMVKRELTKGLCSG

SEQ ID NO: 14448 - protein, 306 aa, Homo Sapiens
MAQISSGGGGQSRCLLFALGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLIRHQKTHLGEQAGKDSS

SEQ ID NO: 14449 - protein, 306 aa, Homo Sapiens; identical to SEQ ID NO: 14448

SEQ ID NO: 14450 - protein, 133 aa, Homo Sapiens
MAQISSGGGGQSRCLLFALVLAICVHSQGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTH

SEQ ID NO: 14451 - protein, 284 aa, Homo Sapiens
MGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLIRHQKTHLGEQAGKDSS

SEQ ID NO: 14452 - protein, 284 aa, Homo Sapiens; identical to SEQ ID NO: 14451

SEQ ID NO: 14453 - protein, 284 aa, Homo Sapiens; identical to SEQ ID NO: 14451

SEQ ID NO: 14454 - protein, 315 aa, Homo Sapiens
MSLCSPTHSAEMSLFLQGPEEMLPLSSEGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLIRHQKTHLGEQAGKDSS

SEQ ID NO: 14455 - protein, 296 aa, Homo Sapiens
MSLCSPTHSAEMSLFLQGPEEMLPLSSEGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSS

SEQ ID NO: 14456 - protein, 130 aa, Homo Sapiens
MLENYRNLVFVGIAASKPDLITCLEQGKEPWNVKRHEMVTEPPVVYSYFAQDLWPKQGKKNYFQKVILRTYKKCGRENLQLRKYCKSMDECKVHKECYNGLNQCLTTTQNKIFQYDKYVKVFHKFSNSNR

SEQ ID NO: 14457 - protein, 87 aa, Homo Sapiens
MPGPLGSLEMGVLTFRDVALEFSLEEWQCLDTAQQNLYRNVMLENYRNLVFVGIAASKPDLITCLEQGKEPWNVKRHEMVTEPPGLQ

SEQ ID NO: 14458 - protein, 572 aa, Homo Sapiens
MPGPLGSLEMGVLTFRDVALEFSLEEWQCLDTAQQNLYRNVMLENYRNLVFVGIAASKPDLITCLEQGKEPWNVKRHEMVTEPPVVYSYFAQDLWPKQGKKNYFQKVILRTYKKCGRENLQLRKYCKSMDECKVHKECYNGLNQCLTTTQNKIFQYDKYVKVFHKFSNSNRHKIGHTGKKSFKCKECEKSFCMLSHLAQHKRIHSGEKPYKCKECGKAYNEASNLSTHKRIHTGKKPYKCEECGKAFNRLSHLTTHKIIHTGKKPYKCEECGKAFNQSANLTTHKRIHTGEKPYKCEECGRAFSQSSTLTAHKIIHAGEKPYKCEECGKAFSQSSTLTTHKIIHTGEKFYKCEECGKAFSRLSHLTTHKRIHSGEKPYKCEECGKAFKQSSTLTTHKRIHAGEKFYKCEVCSKAFSRFSHLTTHKRIHTGEKPYKCEECGKAFNLSSQLTTHKIIHTGEKPYKCEECGKAFNQSSTLSKHKVIHTGEKPYKCEECGKAFNQSSHLTTHKMIHTGEKPYKCEECGKAFNNSSILNRHKMIHTGEKLYKPESCNNACDNIAKISKYKRNCAGEK

SEQ ID NO: 14459 - protein, 131 aa, Homo Sapiens
MSEETLQSKLAAAKKKLPWGAVQGSRAMSDLLLLLLDLTLLLLLMLLGFAGYSGQLAGVAVSAGSPPIPTSSMWSPMVRLGGFSPELQHLPQTLLHRCPLGQPCMGVLTFRDVALEFSLEEWQCLDTAQQN

SEQ ID NO: 14460 - protein, 75 aa, Homo Sapiens
MEAFALGPARRGRRRTRAAGSLLSRAAILLFISAFLVRVPSSGEGPRRPAGSAGTTAASPTLRIAFSCVTCIRFI

SEQ ID NO: 14461 - protein, 350 aa, Homo Sapiens
MEAFALGPARRGRRRTRAAGSLLSRAAILLFISAFLVRVPSSVGHLVRLPRAFRLTKDSVKIVGSTSFPVKAYVMLHQKSPHVLCVTQQLRNAELIDPSFQWYGPKGKVVSENRTAQITSTGSLVFQNFEESMSGIYTCFLEYKPTVEEIVKRLQLKYAIYAYREPHYYYQFTARYHAAPCNSIYNISFEKKLLQILSKLLLDLSCEISLLKSECHRVKMQRAGLQNELFFAFSVSSLDTEKGPKRCTDHNCEPYKRLFKAKNLIERFFNQQVEILGRRAEQLPQIYYIEGTLQMVWINRCFPGYGMNVQQHPKCPECCVICSPGSYNPRDGIHCLQCNSSLVYGAKTCL

SEQ ID NO: 14462 - protein, 351 aa, Homo Sapiens
MEAFALGPARRGRRRTRAAGSLLSRAAILLFISAFLVRVPSSVGHLVRLPRAFRLTKDSVKIVGSTSFPVKAYVMLHQKSPHVLCVTQQLRNAELIDPSFQWYGPKGKVVSVENRTAQITSTGSLVFQNFEESMSGIYTCFLEYKPTVEEIVKRLQLKYAIYAYREPHYYYQFTARYHAAPCNSIYNISFEKKLLQILSKLLLDLSCEISLLKSECHRVKMQRAGLQNELFFAFSVSSLDTEKGPKRCTDHNCEPYKRLFKAKNLIERFFNQQVEILGRRAEQLPQIYYIEGTLQMVWINRCFPGYGMNVQQHPKCPECCVICSPGSYNPRDGIHCLQCNSSLVYGAKTCL

SEQ ID NO: 14463 - protein, 72 aa, Homo Sapiens
MFLVGHLVRLPRAFRLTKDSVKIVGSTSFPVKAYVMLHQKSPHVLCVTQQLRNAELIDPSFQWYGPKGKVVS

SEQ ID NO: 14464 - protein, 218 aa, Homo Sapiens
MMRTCVLLSAVLWCLTGAYREPDYSYQMAVRFTTRSCIGRYNDVFFRVLKKILDSLISDLSCHVIEPSYKCHSVEIPEHGLIHELFIAFQVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQY

SEQ ID NO: 14465 - protein, 316 aa, Homo Sapiens
MMRTCVLLSAVLWCLTGDKIYVELHQNSPVLICMDFKLSKKEIVDPTYLWIGPNEKTLTGNNRINITETGQLMVKDFLEPLSGLYTCTLSYKTVKAETQEEKTVKKRYDFMVFAYREPDYSYQMAVRFTTRSCIGRYNDVFFRVLKKILDSLISDLSCHVIEPSYKCHSVEIPEHGLIHELFIAFQVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQYED

SEQ ID NO: 14466 - protein, 338 aa, Homo Sapiens
MMRTCVLLSAVLWCLTGVQCPRFTLFNKKGFIYGKTGQPDKIYVELHQNSPVLICMDFKLSKKEIVDPTYLWIGPNEKTLTGNNRINITETGQLMVKDFLEPLSGLYTCTLSYKTVKAETQEEKTVKKRYDFMVFAYREPDYSYQMAVRFTTRSCIGRYNDVFFRVLKKILDSLISDLSCHVIEPSYKCHSVEIPEHGLIHELFIAFQVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQYED

SEQ ID NO: 14467 - protein, 265 aa, Homo Sapiens
MMRTCVLLSAVLWCLTGVQCPRFTLFNKKGFIYGKTGQPDKIYVELHQNSPVLICMDFKLSKKEIVDPTYLWIGPNEKTLTGNNRINITETGQLMVKDFLEPLSGLYTCTLSYKTVKAETQEEKTVKKRYDFMVFVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQYED

SEQ ID NO: 14468 - protein, 330 aa, Homo Sapiens
EQCPENGEEAVTLVEDLEREPGRPRSSVTVSVKGQEVRLEKMTPPKSSQELLSVRQESVEPQPRGVPKKERARSPDLGPQEQMNPKEKLKPFQRSGLPFPKSGVVSRLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGA

SEQ ID NO: 14469 - protein, 462 aa, Homo Sapiens
MAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGFEAGFENEDNSKRDISEEVQLHRTLLARSERKIPRYLHQGKGNESDCRSGRQWAKTSGEKRGKLTLPEKSLSEVLSQQRPCLGERPYKYLKYSKSFGPNSLLMHQVSHQVENPYKCADCGKSFSRSARLIRHRRIHTGEKPYKCLDCGKSFRDSSNFITHRRIHTGEKPYQCGECGKCFNQSSSLIIHQRTHTGEKPYQCEECGKSFNNSSHFSAHRRIHTGERPHVCPDCGKSFSKSSDLRAHHRTHTGEKPYGCHDCGKCFSKSSALNKHGEIHAREKLLTQSAPK

SEQ ID NO: 14470 - protein, 556 aa, Homo Sapiens
MAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGLPFPKSGVVSRLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGVHWGYEETKTYLAILSETQFYEALRNCHRNSQLYGAVAERLWEYGFLRTPEQCRTKFKSLQTSYRKVKNGQAPETCPFFEEMDALVLKLDLRMKIIQNGIFLRKYNCIGHYLQDLKGKFPGIFIRVKAMRVTVDQEDSGQRPQGRKEEN

SEQ ID NO: 14471 - protein, 21 aa, Homo Sapiens
MMAKSALRENGTNSETFRQRF

SEQ ID NO: 14472 - protein, 852 aa, Homo Sapiens
MMAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGLPFPKSGVVSRLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGVHWGYEETKTYLAILSETQFYEALRNCHRNSQLYGAVAERLWEYGFLRTPEQCRTKFKSLQTSYRKVKNGQAPETCPFFEEMDALVSVRVAAPPNDGQEETASCPVQGTSEAEAQKQAEEADEATEEDSDDDEEDTEIPPGAVITRAPVLFQSPRGFEAGFENEDNSKRDISEEVQLHRTLLARSERKIPRYLHQGKGNESDCRSGRQWAKTSGEKRGKLTLPEKSLSEVLSQQRPCLGERPYKYLKYSKSFGPNSLLMHQVSHQVENPYKCADCGKSFSRSARLIRHRRIHTGEKPYKCLDCGKSFRDSSNFITHRRIHTGEKPYQCGECGKCFNQSSSLIIHQRTHTGEKPYQCEECGKSFNNSSHFSAHRRIHTGERPHVCPDCGKSFSKSSDLRAHHRTHTGEKPYGCHDCGKCFSKSSALNKHGEIHAREKLLTQSAPK

SEQ ID NO: 14473 - protein, 199 aa, Homo Sapiens
MMAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGWSKESHGSQICWALRRKNFQVAAT

SEQ ID NO: 14474 - protein, 316 aa, Homo Sapiens
MSRKWRGGSDSRGRFRKRAWKTIFGHSLCEGAGSALGEDDTPEIITRVIKCSAGVSGTPAQGCTQEREGKKPRPGTTGADEPKGEAQTFSKERLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGA

SEQ ID NO: 14475-14483 - skipped (9 entries)

SEQ ID NO: 14484 - protein, 594 aa, Artificial Sequence
  Synthetic Sequence
MGSSLDDEHILSALLQSDDELVGEDSDSEVSDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTSATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRVYIPNKPSKYGIKILMMCDSGTKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPKEVPGTSDDSTEEPVMKKRTYCTYCPSKIRRKANASCKKCKKVICREHNIDMCQSCF

SEQ ID NO: 14485 - protein, 340 aa, Artificial Sequence
  Synthetic Sequence
MGKSKEISQDLRKKIVDLHKSGSSLGAISKRLKVPRSSVQTIVRKYKHHGTTQPSYRSGRRRVLSPRDERTLVRKVQINPRTTAKDLVKMLEETGTKVSISTVKRVLYRHNLKGRSARKKPLLQNRHKKARLRFATAHGDKDRTFWRNVLWSDETKIELFGHNDHRYVWRKKGEACKPKNTIPTVKHGGGSIMLWGCFAAGGTGALHKIDGIMRKENYVDILKQHLKTSVRKLKLGRKWVFQMDNDPKHTSKVVAKWLKDNKVKVLEWPSQSPDLNPIENLWAELKKRVRARRPTNLTQLHQLCQEEWAKIHPTYCGKLVEGYPKRLTQVKQFKGNATKY

SEQ ID NO: 14486 - protein, 340 aa, Artificial Sequence
  Synthetic Sequence
MGKSKEISQDLRKRIVDLHKSGSSLGAISKRLAVPRSSVQTIVRKYKHHGTTQPSYRSGRRRVLSPRDERTLVRKVQINPRTTAKDLVKMLEETGTKVSISTVKRVLYRHNLKGHSARKKPLLQNRHKKARLRFATAHGDKDRTFWRNVLWSDETKIELFGHNDHRYVWRKKGEACKPKNTIPTVKHGGGSIMLWGCFAAGGTGALHKIDGIMDAVQYVDILKQHLKTSVRKLKLGRKWVFQHDNDPKHTSKVVAKWLKDNKVKVLEWPSQSPDLNPIENLWAELKKRVRARRPTNLTQLHQLCQEEWAKIHPNYCGKLVEGYPKRLTQVKQFKGNATKY

SEQ ID NO: 14487 - protein, 594 aa, Artificial Sequence
  Synthetic Sequence
MGSSLDDEHILSALLQSDDELVGEDSDSEISDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGTKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPNEVPGTSDDSTEEPVMKKRTYCTYCPSKIRRKANASCKKCKKVICREHNIDMCQSCF

SEQ ID NO: 14488-14499 - skipped (12 entries)

SEQ ID NO: 14500 - DNA, 30 bp, Artificial Sequence
  Synthetic Sequence
gtgcacgaatttcgtgcaccgggccactag

SEQ ID NO: 14501 - protein, 1496 aa, Artificial Sequence
  Synthetic Sequence
MSKEQLLIQRSSAAERCRRYRQKMSAEQRASDLERRRRLQQNVSEEQLLEKRRSEAEKQRRHRQKMSKDQRAFEVERRRWRRQNMSREQSSTSTTNTGRNCLLSKNGVHEDAILEHSCGGMTVRCEFCLSLNFSDEKPSDGKFTRCCSKGKVCPNDIHFPDYPAYLKRLMTNEDSDSKNFMENIRSINSSFAFASMGANIASPSGYGPYCFRIHGQVYHRTGTLHPSDGVSRKFAQLYILDTAEATSKRLAMPENQGCSERLMININNLMHEINELTKSYKMLHEVEKEAQSEAAAKGIAPTEVTMAIKYDRNSDPGRYNSPRVTEVAVIFRNEDGEPPFERDLLIHCKPDPNNPNATKMKQISILFPTLDAMTYPILFPHGEKGWGTDIALRLRDNSVIDNNTRQNVRTRVTQMQYYGFHLSVRDTFNPILNAGKLTQQFIVDSYSKMEANRINFIKANQSKLRVEKYSGLMDYLKSRSENDNVPIGKMIILPSSFEGSPRNMQQRYQDAMAIVTKYGKPDLFITMTCNPKWADITNNLQRWQKVENRPDLVARVFNIKLNALLNDICKFHLFGKVIAKIHVIEFQKRGLPHAHILLILDSESKLRSEDDIDRIVKAEIPDEDQCPRLFQIVKSNMVHGPCGIQNPNSPCMENGKCSKGYPKEFQNATIGNIDGYPKYKRRSGSTMSIGNKVVDNTWIVPYNPYLCLKYNCHINVEVCASIKSVKYLFKYIYKGHDCANIQISEKNIINHDEVQDFIDSRYVSAPEAVWRLFAMRMHDQSHAITRLAIHLPNDQNLYFHTDDFAEVLDRAKRHNSTLMAWFLLNREDSDARNYYYWEIPQHYVFNNSLWTKRRKGGNKVLGRLFTVSFREPERYYLRLLLLHVKGAISFEDLRTVGGVTYDTFHEAAKHRGLLLDDTIWKDTIDDAIILNMPKQLRQLFAYICVFGCPSAADKLWDENKSHFIEDFCWKLHRREGACVNCEMHALNEIQEVFTLHGMKCSHFKLPDYPLLMNANTCDQLYEQQQAEVLINSLNDEQLAAFQTITSAIEDQTVHPKCFFLDGPGGSGKTYLYKVLTHYIRGRGGTVLPTASTGIAANLLLGGRTFHSQYKLPIPLNETSISRLDIKSEVAKTIKKAQLLIIDECTMASSHAINAIDRLLREIMNLNVAFGGKVLLLGGDFRQCLSIVPHAMRSAIVQTSLKYCNVWGCFRKLSLKTNMRSEDSAYSEWLVKLGDGKLDSSFHLGMDIIEIPHEMICNGSIIEATFGNSISIDNIKNISKRAILCPKNEHVQKLNEEILDILDGDFHTYLSDDSIDSTDDAEKENFPIEFLNSITPSGMPCHKLKLKVGAIIMLLRNLNSKWGLCNGTRFIIKRLRPNIIEAEVLTGSAEGEVVLIPRIDLSPSDTGLPFKLIRRQFPVMPAFAMTINKSQGQTLDRVGIFLPEPVFAHGQLYVAFSRVRRACDVKVKVVNTSSQGKLVKHSESVFTLNVVYREILE

SEQ ID NO: 14502 - protein, 649 aa, Artificial Sequence
  Synthetic Sequence
MEEVCDSSAAASSTVQNQPQDQEHPWPYLREFFSLSGVNKDSFKMKCVLCLPLNKEISAFKSSPSNLRKHIERMHPNYLKNYSKLTAQKRKIGTSTHASSSKQLKVDSVFPVKHVSPVTVNKAILRYIIQGLHPFSTVDLPSFKELISTLQPGISVITRPTLRSKIAEAALIMKQKVTAAMSEVEWIATTTDCWTARRKSFIGVTAHWINPGSLERHSAALACKRLMGSHTFEVLASAMNDIHSEYEIRDKVVCTTTDSGSNFMKAFRVFGVENNDIETEARRCESDDTDSEGCGEGSDGVEFQDASRVLDQDDGFEFQLPKHQKCACHLLNLVSSVDAQKALSNEHYKKLYRSVFGKCQALWNKSSRSALAAEAVESESRLQLLRPNQTRWNSTFMAVDRILQICKEAGEGALRNICTSLEVPMFNPAEMLFLTEWANTMRPVAKVLDILQAETNTQLGWLLPSVHQLSLKLQRLHHSLRYCDPLVDALQQGIQTRFKHMFEDPEIIAAAILLPKFRTSWTNDETIIKRGMDYIRVHLEPLDHKKELANSSSDDEDFFASLKPTTHEASKELDGYLACVSDTRESLLTFPAICSLSIKTNTPLPASAACERLFSTAGLLFSPKRARLDTNNFENQLLLKLNLRFYNFE

SEQ ID NO: 14503 - skipped

SEQ ID NO: 14504 - protein, 610 aa, Bombyx mori
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFDVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELSANYNVSRNSKRWPMTLFYGVLNMAAINACIIYRANKNVTIKRTEFIRSLGLSMIYEHLHSRNKKKNIPTYLRQRIEKQLGEPSPRHVNVPGRYVRCQDCPYKKDRKTKHSCNACAKPICMEHAKFLCENCAELDSSL

SEQ ID NO: 14505 - protein, 610 aa, Bombyx mori
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 14506 - DNA, 375 bp, Bombyx mori
ttatcccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaa

SEQ ID NO: 14507 - DNA, 368 bp, Bombyx mori
tcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccgggttat

SEQ ID NO: 14508 - DNA, 214 bp, Bombyx mori
ttatcccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcat

SEQ ID NO: 14509 - DNA, 195 bp, Bombyx mori
taaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccgggttat

SEQ ID NO: 14510 - DNA, 16 bp, Artificial Sequence
  Synthetic Sequence
cccggcgagcatgagg

SEQ ID NO: 14511 - DNA, 20 bp, Artificial Sequence
  Synthetic Sequence
ttatcccggcgagcatgagg

SEQ ID NO: 14512 - DNA, 20 bp, Artificial Sequence
  Synthetic Sequence
cctcatgctcgccgggttat

SEQ ID NO: 14513 - DNA, 20 bp, Artificial Sequence
  Synthetic Sequence
ttaacccggcgagcatgagg

SEQ ID NO: 14514 - DNA, 20 bp, Artificial Sequence
  Synthetic Sequence
cctcatgctcgccgggttaa

SEQ ID NO: 14515 - DNA, 375 bp, Bombyx mori
ttaacccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaa

SEQ ID NO: 14516 - DNA, 797 bp, Bombyx mori
tcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataattcattattttacaaaataagatcaacataattgagtaaataataataagaacaatattatagtacaacaaaatatgggtatgtcataccctttttttttttttttttttttttttttcgggtagagggccgaacctcctacgaggtccccgcgcaaaaggggcgcgcggggtatgtgagactcaacgatctgcatggtgttgtgagcagaccgcgggcccaaggattttagagcccacccactaaacgactcctctgcactcttacacccgacgtccgatcccctccgaggtcagaacccggatgaggtaggggggctaccgcggtcaacactacaaccagacggcgcggctcaccccaaggacgcccagccgacggagccttcgaggcgaatcgaaggctctgaaacgtcggccgtctcggtacggcagcccgtcgggccgcccagacggtgccgctggtgtcccggaataccccgctggaccagaaccagcctgccgggtcgggacgcgatacaccgtcgaccggtcgctctaatcactccacggcagcgcgctagagtgctggta

SEQ ID NO: 14517 - protein, 589 aa, Xenopus tropicalis
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 14518 - protein, 589 aa, Xenopus tropicalis
MAKRFYSAEEAAAHCMAPSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWNTTTVLSIPVFSATMSRNRYQLLLRFLHFNNNATAVPPDQPDHDRLHKLRPLIDSLSERFAAVYTPCQNICIDESLLLFKGRLRFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRTRKGLPRALLDKKLNRGETYALRKNELLAIKFFDKKNVFMLTSIHDESVIREQRVGRPPKNKPLCSKEYSKYMGGVDRTDQLQHYYNATRKTSAWYKKVGIYLIQMALRNSYIVYKAAVPGPKLSYYKYQLQILPALLFGGVEEQTVPEMLPSDNVARLIGKHFIDTLPPTPGKQRPQKGCKVCRKRGIRRDTRYYCPKCPRNPGLCFKPCFEIYHTQLHY

SEQ ID NO: 14519 - DNA, 185 bp, Xenopus tropicalis
ttaacctttttactgccaatgacgcatgggatacgtcgtggcagtaaaagggcttaaatgccaacgacgcgtcccatacgttgttggcattttaagtcttctctctgcagcggcagcatgtgccgccgctgcagagagtttctagcgatgacagcccctctgggcaacgagccgggggggctgtc

SEQ ID NO: 14520 - DNA, 237 bp, Xenopus tropicalis
tttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttaa

SEQ ID NO: 14521 - DNA, 185 bp, Xenopus tropicalis
ttaaccctttgcctgccaatcacgcatgggatacgtcgtggcagtaaaagggcttaaatgccaacgacgcgtcccatacgttgttggcattttaagtcttctctctgcagcggcagcatgtgccgccgctgcagagagtttctagcgatgacagcccctctgggcaacgagccgggggggctgtc

SEQ ID NO: 14522 - DNA, 238 bp, Xenopus tropicalis
tttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgggacaaatcggctggcagtgaaagggttaa

SEQ ID NO: 14523 - DNA, 185 bp, Xenopus tropicalis
ttaacctttttactgccaatgacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtc

SEQ ID NO: 14524 - DNA, 18 bp, Artificial Sequence
  Synthetic Sequence
ttaacctttttactgcca

SEQ ID NO: 14525 - protein, 597 aa, Helicoverpa armigera
MASRQRLNHDEIATILENDDDYSPLDSESEKEDCVVEDDVWSDNEDAIVDFVEDTSAQEDPDNNIASRESPNLEVTSLTSHRIITLPQRSIRGKNNHVWSTTKGRTTGRTSAINIIRTNRGPTRMCRNIVDPLLCFQLFITDEIIHEIVKWTNVEIIVKRQNLKDISASYRDTNTMEIWALVGILTLTAVMKDNHLSTDELFDATFSGTRYVSVMSRERFEFLIRCIRMDDKTLRPTLRSDDAFLPVRKIWEIFINQCRQNHVPGSNLTVDEQLLGFRGRCPFRMYIPNKPDKYGIKFPMMCAAATKYMIDAIPYLGKSTKTNGLPLGEFYVKDLTKTVHGTNRNITCDNWFTSIPLAKNMLQAPYNLTIVGTIRSNKREMPEEIKNSRSRPVGSSMFCFDGPLTLVSYKPKPSKMVFLLSSCDENAVINESNGKPDMILFYNQTKGGVDSFDQMCKSMSANRKTNRWPMAVFYGMLNMAFVNSYIIYCHNKINKQEKPISRKEFMKKLSIQLTTPWMQERLQAPTLKRTLRDNITNVLKNVVPASSENISNEPEPKKRRYCGVCSYKKRRMTKAQCCKCKKAICGEHNIDVCQDCI

SEQ ID NO: 14526 - DNA, 18 bp, Artificial Sequence
  Synthetic Sequence
ttaaccctttgcctgcca

SEQ ID NO: 14527 - DNA, 18 bp, Artificial Sequence
  Synthetic Sequence
ttaaccyttttactgcca

SEQ ID NO: 14528 - DNA, 367 bp, Helicoverpa armigera
agactgtttttttctaagagacttctaaaatattattacgagttgatttaattttatgaaaacatttaaaactagttgattttttttataattacataattttaagaaaaagtgttagaggcttgatttttttgttgattttttctaagatttgattaaagtgccataatagtattaataaagagtattttttaacttaaaatgtattttatttattaattaaaacttcaattatgataactcatgcaaaaatatagttcattaacagaaaaaaataggaaaactttgaagttttgtttttacacgtcatttttacgtatgattgggctttatagctagttaaatatgattgggcttctagggttaa

SEQ ID NO: 14529 - DNA, 18 bp, Artificial Sequence
  Synthetic Sequence
tggcagtaaaagggttaa

SEQ ID NO: 14530 - protein, 628 aa, Pectinophora gossypiella
MDLRKQDEKIRQWLEQDIEEDSKGESDNSSSETEDIVEMEVHKNTSSESEVSSESDYEPVCPSKRQRTQIIESEESDNSESIRPSRRQTSRVIDSDETDEDVMSSTPQNIPRNPNVIQPSSRFLYGKNKHKWSSAAKPSSVRTSRRNIIHFIPGPKERAREVSEPIDIFSLFISEDMLQQVVTFTNAEMLIRKNKYKTETFTVSPTNLEEIRALLGLLFNAAAMKSNHLPTRMLFNTHRSGTIFKACMSAERLNFLIKCLRFDDKLTRNVRQRDDRFAPIRDLWQALISNFQKWYTPGSYITVDEQLVGFRGRCSFRMYIPNKPNKYGIKLVMAADVNSKYIVNAIPYLGKGTDPQNQPLATFFIKEITSTLHGTNRNITMDNWFTSVPLANELLMAPYNLTLVGTLRSNKREIPEKLKNSKSRAIGTSMFCYDGDKTLVSYKAKSNKVVFILSTIHDQPDINQETGKPEMIHFYNSTKGAVDTVDQMCSSISTNRKTQRWPLCVFYNMLNLSIINAYVVYVYNNVRNNKKPMSRRDFVIKLGDQLMEPWLRQRLQTVTLRRDIKVMIQDILGESSDLEAPVPSVSNVRKIYYLCPSKARRMTKHRCIKCKQAICGPHNIDICSRCIE

SEQ ID NO: 14531 - DNA, 18 bp, Artificial Sequence
  Synthetic Sequence
tggcagtgaaagggttaa

SEQ ID NO: 14532 - DNA, 406 bp, Artificial Sequence
  Synthetic Sequence
ttaaccctagataactaaacattcgtccgctcgacgacgcgctatgccgcgaaattgaagtttacctattattccgcgtcccccgcccccgccgctttttctagcttcctgatttgcaaaatagtgcatcgcgtgacacgctcgaggtcacacgacaattaggtcgaaagttacaggaatttcgtcgtccgctcgacgaaagtttagtaattacgtaagtttggcaaaggtaagtgaatgaagtatttttttataattattttttaattctttatagtgataacgtaaggtttatttaaatttattacttttatagttatttagccaattgttataaattccttgttattgctgaaaaatttgcctgttttagtcaaaatttattaacttttcgatcgttttttag

SEQ ID NO: 14533 - DNA, 18 bp, Artificial Sequence
  Synthetic Sequence
ttaaccytttkmctgcca

SEQ ID NO: 14534 - protein, 599 aa, Argyrogramma agnata
MASRQHLYQDEIAAILENEDDYSPHDTDSEMEDCVTQDDVRSDVEDEMVDNIGNGTSPASRHEDPETPDPSSEASNLEVTLSSHRIIILPQRSIREKNNHIWSTTKGQSSGRTAAINIVRTNRGPTRMCRNIVDPLLCFQLFIKEEIVEEIVKWTNVEMVQKRVNLKDISASYRDTNEMEIWAIISMLTLSAVMKDNHLSTDELFNVSYGTRYVSVMSRERFEFLLRLLRMGDKLLRPNLRQEDAFTPVRKIWEIFINQCRLNYVPGTNLTVDEQLLGFRGRCPFRMYIPNKPDKYGIKFPMVCDAATKYMVDAIPYLGKSTKTQGLPLGEFYVKELTQTVHGTNRNVTCDNWFTSVPLAKSLLNSPYNLTLVGTIRSNKREIPEEVKNSRSRQVGSSMFCFDGPLTLVSYKPKPSKMVFLLSSCNEDAVVNQSNGKPDMILFYNQTKGGVDSFDQMCSSMSTNRKTNRWPMAVFYGMLNMAFVNSYIIYCHNMLAKKEKPLSRKDFMKKLSTDLTTPSMQKRLEAPTLKRSLRDNITNVLKIVPQAAIDTSFDEPEPKKRRYCGFCSYKKKRMTKTQCFKCKKPVCGEHNIDVCQDCI

SEQ ID NO: 14535 - DNA, 326 bp, Ctenoplusia agnata
ttaaccctagaagcccaatctacgtcattctgacgtgtatgtcgccgaaaatactctgtctctttctcctgcacgatcggattgccgcgaacgctcgattcaacccagttggcgccgagatctattggaggactgcggcgttgattcggtaagtcccgccattttgtcatagtaacagtattgcacgtcagcttgacgtatatttgggctttgtgttatttttgtaaattttcaacgttagtttattattgcatctttttgttacattactggtttatttgcatgtattactcaaatattatttttattttagcgtagaaaataca

SEQ ID NO: 14536 - DNA, 370 bp, Ctenoplusia agnata
agactgttttttttgtatttgcattatatattatattctaaagttgatttaattctaagaaaaacattaaaataagtttctttttgtaaaatttaattaattataagaaaaagtttaagttgatctcattttttataaaaatttgcaatgtttccaaagttattattgtaaaagaataaataaaagtaaactgagttttaattgatgttttattatatcattatactatatattacttaaataaaacaataactgaatgtatttctaaaaggaatcactagaaaatatagtgatcaaaaatttacacgtcatttttgcgtatgattgggctttataggttctaaaaatatgattgggcctctagggttaa

SEQ ID NO: 14537 - protein, 597 aa, Agrotis ipsilon
MESRQRLNQDEIATILENDDDYSPLDSDSEAEDRVVEDDVWSDNEDAMIDYVEDTSRQEDPDNNIASQESANLEVTSLTSHRIISLPQRSICGKNNHVWSTTKGRTTGRTSAINIIRTNRGPTRMCRNIVDPLLCFQLFITDEIIHEIVKWTNVEMIVKRQNLIDISASYRDTNTMEMWALVGILTLTAVMKDNHLSTDELFDATFSGTRYVSVMSRERFEFLIRCMRMDDKTLRPTLRSDDAFIPVRKLWEIFINQCRLNYVPGGNLTVDEQLLGFRGRCPFRMYIPNKPDKYGIRFPMMCDAATKYMIDAIPYLGKSTKTNGLPLGEFYVKELTKTVHGTNRNVTCDNWFTSIPLAKNMLQAPYNLTIVGTIRSNKREIPEEIKNSRSRPVGSSMFCFDGPLTLVSYKPKPSRMVFLLSSCDENAVINESNGKPDMILFYNQTKGGVDSFDQMCKSMSANRKTNRWPMAVFYGMLNMAFVNSYIIYCHNKINKQKKPINRKEFMKNLSTDLTTPWMQERLKAPTLKRTLRDNITNVLKNVVPPSPANNSEEPGPKKRSYCGFCSYKKRRMTKTQFYKCKKAICGEHNIDVCQDCV

SEQ ID NO: 14538 - DNA, 323 bp, Agrotis ipsilon
ttaaccctagaagcccaatctacgtaaatttgacgtataccgcggcgaaatatatctgtctctttcacgtttaccgtcggattcccgctaacttcggaaccaactcagtagccattgagaactcccaggacacagttgcgtcatctcggtaagtgccgccattttgttgtaatagacaggttgcacgtcattttgacgtataattgggctttgtgtaacttttgaaattatttataatttttattgatgtgatttatttgagttaatcgtattgtttcgttacatttttcatatgatattaatattttcagattgaatataaa

SEQ ID NO: 14539 - DNA, 367 bp, Agrotis ipsilon
agactgttttttttaaaaggcttataaagtattactattgcgtgatttaattttataaaaatatttaaaaccagttgatttttttaataattacctaattttaagaaaaaatgttagaagcttgatatttttgttgatttttttctaagatttgattaaaaggccataattgtattaataaagagtatttttaacttcaaatttattttatttattaattaaaacttcaattatgataatacatgcaaaaatatagttcatcaacagaaaaatataggaaaactctaatagttttatttttacacgtcatttttacgtatgattgggctttatagctagtcaaatatgattgggcttctagggttaa

SEQ ID NO: 14540 - protein, 520 aa, Megachile rotundata
MNGKDSLGEFYLDDLSDCLDCRSASSTDDESDSSNIAIRKRCPIPLIYSDSEDEDMNNNVEDNNHFVKESNRYHYQIVEKYKITSKTKKWKDVTVTEMKKFLGLIILMGQVKKDVLYDYWSTDPSIETPFFSKVMSRNRFLQIMQSWHFYNNNDISPNSHRLVKIQPVIDYFKEKFNNVYKSDQQLSLDECLIPWRGRLSIKTYNPAKITKYGILVRVLSEARTGYVSNFCVYAADGKKIEETVLSVIGPYKNMWHHVYQDNYYNSVNIAKIFLKNKLRVCGTIRKNRSLPQILQTVKLSRGQHQFLRNGHTLLEVWNNGKRNVNMISTIHSAQMAESRNRSRTSDCPIQKPISIIDYNKYMKGVDRADQYLSYYSIFRKTKKWTKRVVMFFINCALFNSFKVYTTLNGQKITYKNFLHKAALSLIEDCGTEEQGTDLPNSEPTTTRTTSRVDHPGRLENFGKHKLVNIVTSGQCKKPLRQCRVCASKKKLSRTGFACKYCNVPLHKGDCFERYHSLKKY

SEQ ID NO: 14541 - DNA, 246 bp, Megachile rotundata
ttaaataatgcccactctagatgaacttaacactttaccgaccggccgtcgattattcgacgtttgctccccagcgcttaccgaccggccatcgattattcgacgtttgcttcccagcgcttaccgaccggtcatcgacttttgatctttccgttagatttggttaggtcagattgacaagtagcaagcatttcgcattctttattcaaataatcggtgcttttttctaagctttagcccttagaa

SEQ ID NO: 14542 - DNA, 244 bp, Megachile rotundata
acaacttcttttttcaacaaatattgttatatggattatttatttatttatttatttatggtatattttatgtttatttatttatggttattatggtatattttatgtaaataataaactgaaaacgattgtaatagatgaaataaatattgttttaacactaatataattaaagtaaaagattttaataaatttcgttaccctacaataacacgaagcgtacaattttaccagagtttattaa

SEQ ID NO: 14543 - protein, 570 aa, Bombus impatiens
MNEKNGIGEFYLDDLSDCPDSYSRSNSGDESDGSDTIIRKRGSVLPPRYSDSEDDEINNVEDNANNVENNDDIWSTNDEAIILEPFEGSPGLKIMPSSAESVTDNVNLFFGDDFFEHLVRESNRYHYQVMEKYKIPSKAKKWTDITVPEMKKFLGLIVLMGQIKKDVLYDYWSTDPSIETPFFSQVMSRNRFVQIMQSWHFCNNDNIPHDSHRLAKIQPVIDYFRRKFNDVYKPCQQLSLDESIIPWRGRLSIKTYNPAKITKYGILVRVLSEAVTGYVCNFDVYAADGKKLEDTAVIEPYKNIWHQIYQDNYYNSVKMARILLKNKVRVCGTIRKNRGLPRSLKTIQLSRGQYEFRRNHQILLEVWNNGRRNVNMISTIHSAQLMESRSKSKRSDVPIQKPNSIIDYNKYMKGVDRADQYLAYYSIFRKTKKWTKRVVMFFINCALFNSFRVYTILNGKNITYKNFLHKVAVSWIEDGETNCTEQDDNLPNSEPTRRAPRLDHPGRLSNYGKHKLINIVTSGRSLKPQRQCRVCAVQKKRSRTCFVCKFCNVPLHKGDCFERYHTLKKY

SEQ ID NO: 14544 - DNA, 278 bp, Bombus impatiens
ttaattttttaacattttaccgaccgatagccgattaatcgggtttttgccgctgacgcttaccgaccgataacctattaatcggctttttgtcgtcgaagcttaccaacctatagcctacctatagttaatcggttgccatggcgataaacaatctttctcattatatgagcagtaatttgttatttagtactaaggtaccttgctcagttgcgtcagttgcgttgctttgtaagctcccacagttttataccaattcgaaaaacttaccgttcgcg

SEQ ID NO: 14545 - DNA, 384 bp, Bombus impatiens
actatttcacatttgaactaaaaaccgttgtaatagataaaataaatataatttagtattaatattatggaaacaaaagattttattcaatttaattatcctatagtaacaaaaagcggccaattttatctgagcatacgaaaagcacagatactcccgcccgacagtctaaaccgaaacagagccggcgccagggagaatctgcgcctgagcagccggtcggacgtgcgtttgctgttgaaccgctagtggtcagtaaaccagaaccagtcagtaagccagtaactgatcagttaactagattgtatagttcaaattgaacttaatctagtttttaagcgtttgaatgttgtctaacttcgttatatattatattctttttaa

SEQ ID NO: 14546 - protein, 345 aa, Mamestra brassicae
MFSFVPNKEQTRTVLIFCFHLKTTAAESHRPLVEAFGEQVPTVKTCERWFQRFKSGDFDVDDKEHGKPPKRYEDAELQALLDEDDAQTQKQLAEQLEVSQQAVSNRLREGGKIQKVGRWVPHELNERQRERRKNTCEILLSRYKRKSFLHRIVTGEEKWIFFVNPKRKKSYVDPGQPATSTARPNRFGKKTRLCVWWDQSGVIYYELLKPGETVNTARYQQQLINLNRALQRKRPEYQKRQHRVIFLHDNAPSHTARAVRDTLETLNWEVLPHAAYSPDLAPSDYHLFASMGHALAEQRFDSYESVEEWLDEWFAAKDDEFYWRGIHKLPERWDNCVASDGKYFE

SEQ ID NO: 14547 - DNA, 174 bp, Mamestra brassicae
ttattgggttgcccaaaaagtaattgcggatttttcatatacctgtcttttaaacgtacatagggatcgaactcagtaaaactttgaccttgtgaaataacaaacttgactgtccaaccaccatagtttggcgcgaattgagcgtcataattgttttgactttttgcagtcaac

SEQ ID NO: 14548 - DNA, 79 bp, Mamestra brassicae
atgattttttctttttaaaccaattttaattagttaattgatataaaaatccgcaattactttttgggcaacccaataa

SEQ ID NO: 14549 - protein, 347 aa, Mayetiola destructor
MENFENWRKRRHLREVLLGHFFAKKTAAESHRLLVEVYGEHALAKTQCFEWFQRFKSGDFDTEDKERPGQPKKFEDEELEALLDEDCCQTQEELAKSLGVTQQAISKRLKAAGYIQKQGNWVPHELKPRDVERRFCMSEMLLQRHKKKSFLSRIITGDEKWIHYDNSKRKKSYVKRGGRAKSTPKSNLHGAKVMLCIWWDQRGVLYYELLEPGQTITGDLYRTQLIRLKQALAEKRPEYAKRHGAVIFHHDNARPHVALPVKNYLENSGWEVLPHPPYSPDLAPSDYHLFRSMQNDLAGKRFTSEQGIRKWLDSFLAAKPAKFFEKGIHELSERWEKVIASDGQYFE

SEQ ID NO: 14550 - DNA, 267 bp, Mayetiola destructor
taagacttccaaaatttccacccgaactttaccttccccgcgcattatgtctctcttttcaccctctgatccctggtattgttgtcgagcacgatttatattgggtgtacaacttaaaaaccggaattggacgctagatgtccacactaacgaatagtgtaaaagcacaaatttcatatatacgtcattttgaaggtacatttgacagctatcaaaatcagtcaataaaactattctatctgtgtgcatcatatttttttattaact

SEQ ID NO: 14551 - DNA, 188 bp, Mayetiola destructor
tgcattcattcattttgttatcgaaataaagcattaattttcactaaaaaattccggtttttaagttgtacacccaatatcatccttagtgacaattttcaaatggctttcccattgagctgaaaccgtggctctagtaagaaaaacgcccaacccgtcatcatatgccttttttttctcaacatccg

SEQ ID NO: 14552 - protein, 342 aa, Apis mellifera
MENQKEHYRHILLFYFRKGKNASQAHKKLCAVYGDEALKERQCQNWFDKFRSGDFSLKDEKRSGRPVEVDDDLIKAIIDSDRHSTTREIAEKLHVSHTCIENHLKQLGYVQKLDTWVPHELKEKHLTQRINSCDLLKKRNENDPFLKRLITGDEKWVVYNNIKRKRSWSRPREPAQTTSKAGIHRKKVLLSVWWDYKGIVYFELLPPNRTINSVVYIEQLTKLNNAVEEKRPELTNRKGVVFHHDNARPHTSLVTRQKLLELGWDVLPHPPYSPDLAPSDYFLFRSLQNSLNGKNFNNDDDIKSYLIQFFANKNQKFYERGIMMLPERWQKVIDQNGQHITE

SEQ ID NO: 14553 - DNA, 184 bp, Apis mellifera
ttgggttggcaactaagtaattgcggatttcactcatagatggcttcagttgaatttttaggtttgctggcgtagtccaaatgtaaaacacattttgttatttgatagttggcaattcagctgtcaatcagtaaaaaaagttttttgatcggttgcgtagttttcgtttggcgttcgttgaaaa

SEQ ID NO: 14554 - DNA, 74 bp, Apis mellifera
agttatttagttccatgaaaaaattgtctttgattttctaaaaaaaatccgcaattacttagttgccaatccaa

SEQ ID NO: 14555 - protein, 345 aa, Messor bouvieri
MSSFVPENVHLRHALLFLFHQKKRAAESHRLLVETYGEHAPTIRTCETWFRQFKCGDFNVQDKERPGRPKTFEDAELQELLDEDSTQTQKQLAEKLNVSRVAICERLQAMGKIQKMGRWVPHELNDRQMENRKIVSEMLLQRYERKSFLHRIVTGDEKWIYFENPKRKKSWLSPGEAGPSTARPNRFGRKTMLCVWWDQIGVVYYELLKPGETVNTDRYRQQMINLNCALIEKRPQYAQRHDKVILQHDNAPSHTAKPVKEMLKSLGWEVLSHPPYSPDLAPSDYHLFASMGHALAEQHFADFEEVKKWLDEWFSSKEKLFFWNGIHKLSERWTKCIESNGQYFE

SEQ ID NO: 14556 - DNA, 242 bp, Messor bouvieri
agtcagaaatgacacctcgatcgacgactaatcgacgtctaatcgacgtcgattttatgtcaacatgttaccaggtgtgtcggtaattcctttccggtttttccggcagatgtcactagccataagtatgaaatgttatgatttgatacatatgtcattttattctactgacattaaccttaaaactacacaagttacgttccgccaaaataacagcgttatagatttataattttttgaaa

SEQ ID NO: 14557 - DNA, 146 bp, Messor bouvieri
ataaatttgaactatccattctaagtaacgtgttttctttaacgaaaaaaccggaaaagaattaccgacactcctggtatgtcaacatgttattttcgacattgaatcgcgtcgattcgaagtcgatcgaggtgtcatttctgact

SEQ ID NO: 14558 - protein, 594 aa, Trichoplusia ni; identical to SEQ ID NO: 14484

SEQ ID NO: 14559 - DNA, 313 bp, Trichoplusia ni
ttaaccctagaaagatagtctgcgtaaaattgacgcatgcattcttgaaatattgctctctctttctaaatagcgcgaatccgtcgctgtgcatttaggacatctcagtcgccgcttggagctcccgtgaggcgtgcttgtcaatgcggtaagtgtcactgattttgaactataacgaccgcgtgagtcaaaatgacgcatgattatcttttacgtgacttttaagatttaactcatacgataattatattgttatttcatgttctacttacgtgataacttattatatatatattttcttgttatagatatc

SEQ ID NO: 14560 - DNA, 235 bp, Trichoplusia ni
tttgttactttatagaagaaattttgagtttttgtttttttttaataaataaataaacataaataaattgtttgttgaatttattattagtatgtaagtgtaaatataataaaacttaatatctattcaaattaataaataaacctcgatatacagaccgataaaacacatgcgtcaattttacgcatgattatctttaacgtacgtcacaatatgattatctttctagggttaa

SEQ ID NO: 14561 - DNA, 309 bp, Trichoplusia ni
ccctagaaagatagtctgcgtaaaattgacgcatgcattcttgaaatattgctctctctttctaaatagcgcgaatccgtcgctgtgcatttaggacatctcagtcgccgcttggagctcccgtgaggcgtgcttgtcaatgcggtaagtgtcactgattttgaactataacgaccgcgtgagtcaaaatgacgcatgattatcttttacgtgacttttaagatttaactcatacgataattatattgttatttcatgttctacttacgtgataacttattatatatatattttcttgttatagatatc

SEQ ID NO: 14562 - DNA, 231 bp, Trichoplusia ni
tttgttactttatagaagaaattttgagtttttgtttttttttaataaataaataaacataaataaattgtttgttgaatttattattagtatgtaagtgtaaatataataaaacttaatatctattcaaattaataaataaacctcgatatacagaccgataaaacacatgcgtcaattttacgcatgattatctttaacgtacgtcacaatatgattatctttctaggg

SEQ ID NO: 14563 - DNA, 14 bp, Artificial Sequence
  Synthetic Sequence
ccytttkmctgcca

SEQ ID NO: 14564 - DNA, 16 bp, Artificial Sequence
  Synthetic Sequence
ccctagaagcccaatc

SEQ ID NO: 14565 - DNA, 17 bp, Artificial Sequence
  Synthetic Sequence
ccttccagcgggcgcgc

SEQ ID NO: 14566 - DNA, 13 bp, Artificial Sequence
  Synthetic Sequence
cccagattagcct

SEQ ID NO: 14567 - DNA, 16 bp, Artificial Sequence
  Synthetic Sequence
cccttaattactcgcg

SEQ ID NO: 14568 - DNA, 16 bp, Artificial Sequence
  Synthetic Sequence
ccctagataactaaac

SEQ ID NO: 14569 - DNA, 13 bp, Artificial Sequence
  Synthetic Sequence
ccctagaaagata

SEQ ID NO: 14570 - DNA, 347 bp, Helicoverpa armigera
ttaaccctagaagcccaatctacgtaaatttgacgtataccgcggcgaaatatctctgtctctttcatgtttaccgtcggatcgccgctaacttctgaaccaactcagtagccattgggacctcgcaggacacagttgcgtcatctcggtaagtgccgccattttgttgtactctctattacaacacacgtcacgtcacgtcgttgcacgtcattttgacgtataattgggctttgtgtaacttttgaatttgtttcaaattttttatgtttgtgatttatttgagttaatcgtattgtttcgttacatttttcatataataataatattttcaggttgagtacaaa

SEQ ID NO: 14571 - DNA, 179 bp, pectinophora gossypiella
tttcactaagtaattttgttcctatttagtagataagtaacacataattattgtgatattcaaaacttaagaggtttaataaataataataaaaaaaaaatggtttttatttcgtagtctgctcgacgaatgtttagttattacgtaaccgtgaatatagtttagtagtctagggttaa

SEQ ID NO: 14572 - protein, 589 aa, Artificial Sequence
  Synthetic Sequence
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 14573 - DNA, 78 bp, Xenopus tropicalis
ccctttgcctgccaatcacgcatgggatacgtcgtggcagtaaaagggcttaaatgccaacgacgcgtcccatacgtt

SEQ ID NO: 14574 - DNA, 120 bp, Xenopus tropicalis
cctgggtaaactaaaagtcccctcgaggaaaggcccctaaagtgaaacagtgcaaaacgttcaaaaactgtctggcaatacaagttccactttgggacaaatcggctggcagtgaaaggg

SEQ ID NO: 14575 - protein, 14 aa, Artificial Sequence
  Synthetic Sequence
CCYTTTBMCTGCCA

SEQ ID NO: 14576 - protein, 610 aa, Artificial Sequence
  Synthetic Sequence
MDIERQEERIRAMLEEELSDYSDESSSEDETDHCSEHEVNYDTEEERIDSVDVPSNSRQEEANAIIANESDSDPDDDLPLSLVRQRASASRQMSGPHYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSHL

SEQ ID NO: 14577 - DNA, 221 bp, Bombyx mori
cccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtat

SEQ ID NO: 14578 - DNA, 208 bp, Bombyx mori
tttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccggg

SEQ ID NO: 14579 - DNA, 181 bp, Xenopus tropicalis
ccctttgcctgccaatcacgcatgggatacgtcgtggcagtaaaagggcttaaatgccaacgacgcgtcccatacgttgttggcattttaagtcttctctctgcagcggcagcatgtgccgccgctgcagagagtttctagcgatgacagcccctctgggcaacgagccgggggggctgtc

SEQ ID NO: 14580 - DNA, 181 bp, Xenopus tropicalis
cctttttactgccaatgacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtc

SEQ ID NO: 14581 - DNA, 181 bp, Xenopus tropicalis
cctttttactgccaatgacgcatgggatacgtcgtggcagtaaaagggcttaaatgccaacgacgcgtcccatacgttgttggcattttaagtcttctctctgcagcggcagcatgtgccgccgctgcagagagtttctagcgatgacagcccctctgggcaacgagccgggggggctgtc

SEQ ID NO: 14582 - DNA, 134 bp, Xenopus tropicalis
cctttttactgccaatgacgcatgggatacgtcgtggcagtaaaagggcttaaatgccaacgacgcgtcccatacgttgttggcattttaagtcttctctctgcagcggcagcatgtgccgccgctgcagagag

SEQ ID NO: 14583 - DNA, 96 bp, Xenopus tropicalis
cctttttactgccaatgacgcatgggatacgtcgtggcagtaaaagggcttaaatgccaacgacgcgtcccatacgttgttggcattttaagtctt

SEQ ID NO: 14584 - DNA, 96 bp, Xenopus tropicalis
ccctttgcctgccaatcacgcatgggatacgtcgtggcagtaaaagggcttaaatgccaacgacgcgtcccatacgttgttggcattttaagtctt

SEQ ID NO: 14585 - DNA, 185 bp, Xenopus tropicalis
ttatcctttttactgccaatgacgcatgggatacgtcgtggcagtaaaagggcttaaatgccaacgacgcgtcccatacgttgttggcattttaagtcttctctctgcagcggcagcatgtgccgccgctgcagagagtttctagcgatgacagcccctctgggcaacgagccgggggggctgtc

SEQ ID NO: 14586 - DNA, 234 bp, Xenopus tropicalis
tttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgggacaaatcggctggcagtgaaaggg

SEQ ID NO: 14587 - DNA, 233 bp, Xenopus tropicalis
tttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaaggg

SEQ ID NO: 14588 - DNA, 148 bp, Xenopus tropicalis
ttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaaggg

SEQ ID NO: 14589 - DNA, 237 bp, Xenopus tropicalis
tttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttat

SEQ ID NO: 14590 - DNA, 149 bp, Xenopus tropicalis
ttgttctgaaaaaaacaatatattgttttcctgggtaaactaaaagtcccctcgaggaaaggcccctaaagtgaaacagtgcaaaacgttcaaaaactgtctggcaatacaagttccactttgggacaaatcggctggcagtgaaaggg

SEQ ID NO: 14591 - DNA, 64 bp, Artificial Sequence
  Synthetic Sequence
atcacgcatgggatacgtcgtggcagtaaaagggcttaaatgccaacgacgcgtcccatacgtt

SEQ ID NO: 14592 - DNA, 82 bp, Artificial Sequence
  Synthetic Sequence
atgacgcatgggatacgtcgtggcagtaaaagggcttaaatgccaacgacgcgtcccatacgttgttggcattttaagtctt

SEQ ID NO: 14593 - DNA, 106 bp, Artificial Sequence
  Synthetic Sequence
cctgggtaaactaaaagtcccctcgaggaaaggcccctaaagtgaaacagtgcaaaacgttcaaaaactgtctggcaatacaagttccactttgggacaaatcggc

SEQ ID NO: 14594 - DNA, 134 bp, Artificial Sequence
  Synthetic Sequence
ttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggc

SEQ ID NO: 14595 - DNA, 371 bp, Bombyx mori
cccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaa

SEQ ID NO: 14596 - DNA, 364 bp, Bombyx mori
tcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccggg

SEQ ID NO: 14597 - DNA, 301 bp, Bombyx mori
cccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatg

SEQ ID NO: 14598 - DNA, 285 bp, Bombyx mori
cagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatg

SEQ ID NO: 14599 - DNA, 205 bp, Bombyx mori
cagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtat

SEQ ID NO: 14600 - DNA, 364 bp, Bombyx mori; identical to SEQ ID NO: 14596

SEQ ID NO: 14601 - DNA, 192 bp, Bombyx mori
tttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttca

SEQ ID NO: 14602 - DNA, 371 bp, Bombyx mori; identical to SEQ ID NO: 14595

SEQ ID NO: 14603 - DNA, 16 bp, Artificial Sequence
  Synthetic Sequence
cctcatgctcgccggg

SEQ ID NO: 14604 - protein, 589 aa, Artificial Sequence
  Synthetic Sequence
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQVPLPRYARAHAWHPTDIAEMKRFVGLTLAMGLIKANSLESYWDTTTVLNIPVFSATMSRNRYQLLLRFLEFNNEATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 14605 - protein, 592 aa, Artificial Sequence
  Synthetic Sequence
MAKRFYSAEEAAAHCMASSSEEFSGSDSEYVPPASESDSSTEESWCSSSTVSALEEPMEVDEDVDDLEDQEAGDRVDAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLKFLHFNNEATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 14606 - protein, 610 aa, Artificial Sequence
  Synthetic Sequence
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRKDGTGVDIFRTTMSLQRFQFLLNNIRFDDISTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMMYEHLHSRNKKKNIPTYLRQRIEKQLGEPVPRHVNVPGRYVRCQDCPYKKDRKTKRSCNACAKPICMEHAKFLCENCAELDSSL

SEQ ID NO: 14607 - protein, 610 aa, Artificial Sequence
  Synthetic Sequence
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFYFLQNNIRFDDKSTLDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNYPGRYVRCQDCPYKKDRKTKRSCNACAKPICMEHAKFLCVNCAELDSSL

SEQ ID NO: 14608 - protein, 610 aa, Artificial Sequence
  Synthetic Sequence
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRKDGTGVDIFRTTMSLQRFQFLLNNIRFDDKSTRDERKQTDNMAAFRSIFDQFVQCCQNAYSPSEFLTIDEMLLSFRGRCLFRVYIPNKPAKYGIKILALVDAKNDYVVNLEVYAGKQPSGPYAVSNRPFEVVERLIQPVARSHRNVTFDNWFTGYECMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELDSSL

SEQ ID NO: 14609 - DNA, 249 bp, Trichoplusia ni
tctaaatagcgcgaatccgtcgctgtgcatttaggacatctcagtcgccgcttggagctcccgtgaggcgtgcttgtcaatgcggtaagtgtcactgattttgaactataacgaccgcgtgagtcaaaatgacgcatgattatcttttacgtgacttttaagatttaactcatacgataattatattgttatttcatgttctacttacgtgataacttattatatatatattttcttgttatagatatc

SEQ ID NO: 14610 - DNA, 231 bp, Trichoplusia ni; identical to SEQ ID NO: 14562

SEQ ID NO: 14611 - protein, 592 aa, Artificial Sequence
  Synthetic Sequence
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNVLPRYARAHAWHPTDIAEMKRFVGLTLAMGLIKANSLESYWDTTTVLSIPVFSATMSRNRYQLLLRFLHFNNDATAVPPDQPGHDRLHKLRPLIDSLTERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 14612 - protein, 592 aa, Artificial Sequence
  Synthetic Sequence
MAKRFYSAEEAAAHCMASSSEEFSGSDSEYVPPASESDSSTEESWCSSSTVSALEEPMEVDEDVDDLEDQEAGDRADAAPGGEPAWGPPCNFPPEIPPFTTVPGVKVDTSNFEPINFFQLFMTEAILQDMVLYTNVYAEQYLTQVPLPRYARAHAWHPTDIAEMKRFVGLTLAMGLIKANSLESYWDTTTVLSIPVFSATMSRNRYQLLLRFLHFNNEATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 14613 - protein, 592 aa, Artificial Sequence
  Synthetic Sequence
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQVPLPRYARAHAWHPTDIAEMKRFVGLTLAMGLIKANSLESYWDTTTVLNIPVFSATMSRNRYQLLLRFLEFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 14614 - DNA, 14 bp, Artificial Sequence
  Synthetic Sequence
atgaggcagggtat

SEQ ID NO: 14615 - DNA, 14 bp, Artificial Sequence
  Synthetic Sequence
ataccctgcctcat

SEQ ID NO: 14616 - DNA, 10 bp, Artificial Sequence
  Synthetic Sequence
ggcagggtat

SEQ ID NO: 14617 - DNA, 10 bp, Artificial Sequence
  Synthetic Sequence
ataccctgcc

SEQ ID NO: 14618 - DNA, 10 bp, Artificial Sequence
  Synthetic Sequence
taaaatttta

SEQ ID NO: 14619 - DNA, 12 bp, Artificial Sequence
  Synthetic Sequence
attttataaaat

SEQ ID NO: 14620 - DNA, 10 bp, Artificial Sequence
  Synthetic Sequence
tcataccctg

SEQ ID NO: 14621 - DNA, 13 bp, Artificial Sequence
  Synthetic Sequence
taaataataataa

SEQ ID NO: 14622 - DNA, 14 bp, Artificial Sequence
  Synthetic Sequence
ccctttgcctgcca

SEQ ID NO: 14623 - DNA, 14 bp, Artificial Sequence
  Synthetic Sequence
tggcagtgaaaggg

SEQ ID NO: 14624 - protein, 589 aa, Artificial Sequence
  Synthetic Sequence
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 14625 - protein, 589 aa, Artificial Sequence
  Synthetic Sequence
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLKIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 14626 - DNA, 1794 bp, Artificial Sequence
  Synthetic Nucleotide
atggcacccaaaaagaaacgtaaagtgatggccaaaagattttacagcgccgaagaagcagcagcacattgcatggcatcgtcatccgaagaattctcggggagcgattccgaatatgtcccaccggcctcggaaagcgattcgagcactgaggagtcgtggtgttcctcctcaactgtctcggctcttgaggagccgatggaagtggatgaggatgtggacgacttggaggaccaggaagccggagacagggccgacgctgccgcgggaggggagccggcgtggggacctccatgcaattttcctcccgaaatcccaccgttcactactgtgccgggagtgaaggtcgacacgtccaacttcgaaccgatcaatttctttcaactcttcatgactgaagcgatcctgcaagatatggtgctctacactaatgtgtacgccgagcagtacctgactcaaaacccgctgcctcgctacgcgagagcgcatgcgtggcacccgaccgatatcgcggagatgaagcggttcgtgggactgaccctcgcaatgggcctgatcaaggccaacagcctcgagtcatactgggataccacgactgtgcttagcattccggtgttctccgctaccatgtcccgtaaccgctaccaactcctgctgcggttcctccacttcaacaacaatgcgaccgctgtgccacctgaccagccaggacacgacagactccacaagctgcggccattgatcgactcgctgagcgagcgattcgccgcggtgtacaccccttgccaaaacatttgcatcgacgagtcgcttctgctgtttaaaggccggcttcagttccgccagtacatcccatcgaagcgcgctcgctatggtatcaaattctacaaactctgcgagtcgtccagcggctacacgtcatacttcttgatctacgaggggaaggactctaagctggacccaccggggtgtccaccggatcttactgtctccggaaaaatcgtgtgggaactcatctcacctctcctcggacaaggctttcatctctacgtcgacaatttctactcatcgatccctctgttcaccgccctctactgcctggatactccagcctgtgggaccattaacagaaaccggaagggtctgccgagagcactgctggataagaagttgaacaggggagagacttacgcgctgagaaagaacgaactcctcgccatcaaattcttcgacaagaaaaatgtgtttatgctcacctccatccacgacgaatccgtcatccgggagcagcgcgtgggcaggccgccgaaaaacaagccgctgtgctctaaggaatactccaagtacatggggggtgtcgaccggaccgatcagctgcagcattactacaacgccactagaaagacccgggcctggtacaagaaagtcggcatctacctgatccaaatggcactgaggaattcgtatattgtctacaaggctgccgttccgggcccgaaactgtcatactacaagtaccagcttcaaatcctgccggcgctgctgttcggtggagtggaagaacagactgtgcccgagatgccgccatccgacaacgtggcccggttgatcggaaagcacttcattgataccctgcctccgacgcctggaaagcagcggccacagaagggatgcaaagtttgccgcaagcgcggaatacggcgcgatacccgctactattgcccgaagtgcccccgcaatcccggactgtgtttcaagccctgttttgaaatctaccacacccagttgcattac

SEQ ID NO: 14627 - protein, 589 aa, Artificial Sequence
  Synthetic Sequence
MAKRFYSAEEAAAHCMASSSEQTSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 14628 - protein, 589 aa, Artificial Sequence
  Synthetic Sequence
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 14629 - DNA, 1857 bp, Artificial Sequence
  Synthetic Sequence
atggcacccaaaaagaaacgtaaagtgatggacattgaaagacaggaagaaagaatcagggcgatgctcgaagaagaactgagcgactactccgacgaatcgtcatcagaggatgaaaccgaccactgtagcgagcatgaggttaactacgacaccgaggaggagagaatcgactctgtggatgtgccctccaactcacgccaagaagaggccaatgcaattatcgcaaacgaatcggacagcgatccagacgatgatctgccactgtccctcgtgcgccagcgggccagcgcttcgagacaagtgtcaggtccattctacacttcgaaggacggcactaagtggtacaagaattgccagcgacctaacgtcagactccgctccgagaatatcgtgaccgaacaggctcaggtcaagaatatcgcccgcgacgcctcgactgagtacgagtgttggaatatcttcgtgacttcggacatgctgcaagaaattctgacgcacaccaacagctcgattaggcatcgccagaccaagactgcagcggagaactcatcggccgaaacctccttctatatgcaagagactactctgtgcgaactgaaggcgctgattgcactgctgtacttggccggcctcatcaaatcaaataggcagagcctcaaagatctctggagaacggatggaactggagtggatatctttcggacgactatgagcttgcagcggttccagtttctgcaaaacaatatcagattcgacgacaagtccacccgggacgaaaggaaacagactgacaacatggctgcgttccggtcaatattcgatcagtttgtgcagtgctgccaaaacgcttatagcccatcggaattcctgaccatcgacgaaatgcttctctccttccgggggcgctgcctgttccgagtgtacatcccgaacaagccggctaaatacggaatcaaaatcctggccctggtggacgccaagaatttctacgtcgtgaatctcgaagtgtacgcaggaaagcaaccgtcgggaccgtacgctgtttcgaaccgcccgtttgaagtcgtcgagcggcttattcagccggtggccagatcccaccgcaatgttaccttcgacaattggttcaccggctacgagctgatgcttcaccttctgaacgagtaccggctcactagcgtggggactgtcaggaagaacaagcggcagatcccagaatccttcatccgcaccgaccgccagcctaactcgtccgtgttcggatttcaaaaggatatcacgcttgtctcgtacgcccccaagaaaaacaaggtcgtggtcgtgatgagcaccatgcatcacgacaacagcatcgacgagtcaaccggagaaaagcaaaagcccgagatgatcaccttctacaattcaactaaggccggcgtcgacgtcgtggatgaactgtgcgcgaactataacgtgtcccggaactctaagcggtggcctatgactctcttctacggagtgctgaatatggccgcaatcaacgcgtgcatcatctaccgcaccaacaagaacgtgaccatcaagcgcaccgagttcatcagatcgctgggtttgagcatgatctacgagcacctccattcacggaacaagaagaagaatatccctacttacctgaggcagcgtatcgagaagcagttgggagaaccaagcccgcgccacgtgaacgtgccggggcgctacgtgcggtgccaagattgcccgtacaaaaaggaccgcaaaaccaaaagatcgtgtaacgcgtgcgccaaacctatctgcatggagcatgccaaatttctgtgtgaaaattgtgctgaactcgattcctccctg

SEQ ID NO: 14630 - protein, 608 aa, Artificial Sequence
  Synthetic Sequence
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDS

SEQ ID NO: 14631 - protein, 610 aa, Artificial Sequence
  Synthetic Sequence
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIAMQLGEPSPRHVNVPGRYVRCQDCPYKKDRKTKRSCNACAKPICMEHAKFLCENCAELDSSL

SEQ ID NO: 14632 - protein, 610 aa, Artificial Sequence
  Synthetic Sequence
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKTQIPENFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 14633 - protein, 610 aa, Artificial Sequence
  Synthetic Sequence
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 14634 - protein, 610 aa, Artificial Sequence
  Synthetic Sequence
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNDYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSSRHVNVKGRYVRCQDCPYKKDRKTKRSCNACAKPICMEHAKFLCENCAELDSSL

SEQ ID NO: 14635 - protein, 107 aa, Homo Sapiens
GVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 14636 - DNA, 321 bp, Artificial Sequence
  Synthetic Sequence
ggggtccaggtcgagactatttcaccaggggatgggcgaacatttccaaaaaggggccagacttgcgtcgtgcattacaccgggatgctggaggacgggaagaaagtggacagctccagggatcgcaacaagcccttcaagttcatgctgggaaagcaggaagtgatccgaggatgggaggaaggcgtggcacagatgtcagtcggccagcgggccaaactgaccattagccctgactacgcttatggagcaacaggccacccagggatcattccccctcatgccaccctggtcttcgatgtggaactgctgaagctggag

SEQ ID NO: 14637 - protein, 5 aa, Artificial Sequence
  Synthetic Sequence
GGGGS

SEQ ID NO: 14638 - DNA, 15 bp, Artificial Sequence
  Synthetic Sequence
ggaggaggaggatcc

SEQ ID NO: 14639 - protein, 282 aa, Artificial Sequence
  Synthetic Sequence
GFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 14640 - DNA, 846 bp, Artificial Sequence
  Synthetic Sequence
ggatttggggacgtgggggccctggagtctctgcgaggaaatgccgatctggcttacatcctgagcatggaaccctgcggccactgtctgatcattaacaatgtgaacttctgcagagaaagcggactgcgaacacggactggctccaatattgactgtgagaagctgcggagaaggttctctagtctgcactttatggtcgaagtgaaaggggatctgaccgccaagaaaatggtgctggccctgctggagctggctcagcaggaccatggagctctggattgctgcgtggtcgtgatcctgtcccacgggtgccaggcttctcatctgcagttccccggagcagtgtacggaacagacggctgtcctgtcagcgtggagaagatcgtcaacatcttcaacggcacttcttgccctagtctggggggaaagccaaaactgttctttatccaggcctgtggcggggaacagaaagatcacggcttcgaggtggccagcaccagccctgaggacgaatcaccagggagcaaccctgaaccagatgcaactccattccaggagggactgaggacctttgaccagctggatgctatctcaagcctgcccactcctagtgacattttcgtgtcttacagtaccttcccaggctttgtctcatggcgcgatcccaagtcagggagctggtacgtggagacactggacgacatctttgaacagtgggcccattcagaggacctgcagagcctgctgctgcgagtggcaaacgctgtctctgtgaagggcatctacaaacagatgcccgggtgcttcaattttctgagaaagaaactgttctttaagacttcc

SEQ ID NO: 14641 - protein, 394 aa, Artificial Sequence
  Synthetic Sequence
GVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGGGGSGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 14642 - DNA, 1182 bp, Artificial Sequence
  Synthetic Sequence
ggggtccaggtcgagactatttcaccaggggatgggcgaacatttccaaaaaggggccagacttgcgtcgtgcattacaccgggatgctggaggacgggaagaaagtggacagctccagggatcgcaacaagcccttcaagttcatgctgggaaagcaggaagtgatccgaggatgggaggaaggcgtggcacagatgtcagtcggccagcgggccaaactgaccattagccctgactacgcttatggagcaacaggccacccagggatcattccccctcatgccaccctggtcttcgatgtggaactgctgaagctggagggaggaggaggatccggatttggggacgtgggggccctggagtctctgcgaggaaatgccgatctggcttacatcctgagcatggaaccctgcggccactgtctgatcattaacaatgtgaacttctgcagagaaagcggactgcgaacacggactggctccaatattgactgtgagaagctgcggagaaggttctctagtctgcactttatggtcgaagtgaaaggggatctgaccgccaagaaaatggtgctggccctgctggagctggctcagcaggaccatggagctctggattgctgcgtggtcgtgatcctgtcccacgggtgccaggcttctcatctgcagttccccggagcagtgtacggaacagacggctgtcctgtcagcgtggagaagatcgtcaacatcttcaacggcacttcttgccctagtctggggggaaagccaaaactgttctttatccaggcctgtggcggggaacagaaagatcacggcttcgaggtggccagcaccagccctgaggacgaatcaccagggagcaaccctgaaccagatgcaactccattccaggagggactgaggacctttgaccagctggatgctatctcaagcctgcccactcctagtgacattttcgtgtcttacagtaccttcccaggctttgtctcatggcgcgatcccaagtcagggagctggtacgtggagacactggacgacatctttgaacagtgggcccattcagaggacctgcagagcctgctgctgcgagtggcaaacgctgtctctgtgaagggcatctacaaacagatgcccgggtgcttcaattttctgagaaagaaactgttctttaagacttcc

SEQ ID NO: 14643 - protein, 288 aa, Homo Sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 14644 - protein, 520 aa, Homo Sapiens
MGKPSSMDTKFKDDLFRKYVQFHESKVDTTTSRQRPGSDECLRVAASTLLSLHKVDPFYRFRLIQFYEVVESSLRSLSSSSLRALHGAFSMLETVGINLFLYPWKKEFRSIKTYTGPFVYYVKSTLLEEDIRAILSCMGYTPELGTAYKLRELVETLQVKMVSFELFLAKVECEQMLEIHSQVKDKGYSELDIVSERKSSAEDVRGCSDALRRRAEGREHLTASMSRVALQKSASERAAKDYYKPRVTKPSRSVDAYDSYWESRKPPLKASLSLRKEPVATDVGDDLKDEIIRPSPSLLTMASSPHGSPDVLPPASPSNGPALLRGTYFSTQDDVDLYTDSEPRATYRRQDALRPDVWLLRNDAHSLYHKRSPPAKESALSKCQSCGLSCSSSLCQRCDSLLTCPPASKPSAFPSKASTHDSLAHGASLREKYPGQTQGLDRLPHLHSKSKPSTTPTSRCGFCNRPGATNTCTQCSKVSCDACLSAYHYDPCYKKSELHKFMPNNQLNYKSTQLSHLVYR

SEQ ID NO: 14645 - protein, 503 aa, Homo Sapiens; identical to SEQ ID NO: 13181

SEQ ID NO: 14646 - protein, 567 aa, Homo Sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 14647 - protein, 301 aa, Homo Sapiens
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 14648 - protein, 525 aa, Homo Sapiens; identical to SEQ ID NO: 7633

SEQ ID NO: 14649 - protein, 223 aa, Homo Sapiens; identical to SEQ ID NO: 3669

SEQ ID NO: 14650 - protein, 289 aa, Homo Sapiens
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 14651 - protein, 296 aa, Homo Sapiens
MTLNNVTMRQGTVGMQPQQQRWSIPADGRHLMVQKEPHQYSHRNRHSATPEDHCRRSWSSDSTDSVISSESGNTYYRVVLIGEQGVGKSTLANIFAGVHDSMDSDCEVLGEDTYERTLMVDGESATIILLDMWENKGENEWLHDHCMQVGDAYLIVYSITDRASFEKASELRIQLRRARQTEDIPIILVGNKSDLVRCREVSVSEGRACAVVFDCKFIETSAAVQHNVKELFEGIVRQVRLRRDSKEKNERRLAYQKRKESMPRKARRFWGKIVAKNNKNMAFKLKSKSCHDLSVL

SEQ ID NO: 14652 - protein, 450 aa, Homo Sapiens
MGSLQPDAGNASWNGTEAPGGGARATPYSLQVTLTLVCLAGLLMLLTVFGNVLVIIAVFTSRALKAPQNLFLVSLASADILVATLVIPFSLANEVMGYWYFGKAWCEIYLALDVLFCTSSIVHLCAISLDRYWSITQAIEYNLKRTPRRIKAIIITVWVISAVISFPPLISIEKKGGGGGPQPAEPRCEINDQKWYVISSCIGSFFAPCLIMILVYVRIYQIAKRRTRVPPSRRGPDAVAAPPGGTERRPNGLGPERSAGPGGAEAEPLPTQLNGAPGEPAPAGPRDTDALDLEESSSSDHAERPPGPRRPERGPRGKGKARASQVKPGDSLPRRGPGATGIGTPAAGPGEERVGAAKASRWRGRQNREKRFTFVLAVVIGVFVVCWFPFFFTYTLTAVGCSVPRTLFKFFFWFGYCNSSLNPVIYTIFNHDFRRAFKKILCRGDRKRIV

SEQ ID NO: 14653 - protein, 311 aa, Homo Sapiens
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 14654 - protein, 244 aa, Homo Sapiens
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 14655 - protein, 290 aa, Homo Sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 14656 - protein, 273 aa, Homo Sapiens
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 14657 - protein, 288 aa, Homo Sapiens; identical to SEQ ID NO: 2417

SEQ ID NO: 14658 - protein, 329 aa, Homo Sapiens; identical to SEQ ID NO: 2420

SEQ ID NO: 14659 - protein, 181 aa, Homo Sapiens; identical to SEQ ID NO: 2218

SEQ ID NO: 14660 - protein, 287 aa, Homo Sapiens
MSPHPTALLGLVLCLAQTIHTQEEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 14661 - protein, 378 aa, Homo Sapiens
MSKEPLILWLMIEFWWLYLTPVTSETVVTEVLGHRVTLPCLYSSWSHNSNSMCWGKDQCPYSGCKEALIRTDGMRVTSRKSAKYRLQGTIPRGDVSLTILNPSESDSGVYCCRIEVPGWFNDVKINVRLNLQRASTTTHRTATTTTRRTTTTSPTTTRQMTTTPAALPTTVVTTPDLTTGTPLQMTTIAVFTTANTCLSLTPSTLPEEATGLLTPEPSKEGPILTAESETVLPSDSWSSVESTSADTVLLTSKESKVWDLPSTSHVSMWKTSDSVSSPQPGASDTAVPEQNKTTKTGQMDGIPMSMKNEMPISQLLMIIAPSLGFVLFALFVAFLLRGKLMETYCSQKHTRLDYIGDSKNVLNDVQHGREDEDGLFTL

SEQ ID NO: 14662 - protein, 370 aa, Homo Sapiens
MLGQVVTLILLLLLKVYQGKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFESLLPDKVEKPRLQGQGKILDRGRCQVALSCLVSRDGNVSYAWYRGSKLIQTAGNLTYLDEEVDINGTHTYTCNVSNPVSWESHTLNLTQDCQNAHQEFRFWPFLVIIVILSALFLGTLACFCVWRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 14663 - protein, 341 aa, Homo Sapiens; identical to SEQ ID NO: 8852

SEQ ID NO: 14664 - protein, 1068 aa, Homo Sapiens
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPNVESSPELPKHIYNKLDKGQIIVVIWVIVSPNNDKQKYTLKINHDCVPEQVIAEAIRKKTRSMLLSSEQLKLCVLEYQGKYILKVCGCDEYFLEKYPLSQYKYIRSCIMLGRMPNLMLMAKESLYSQLPMDCFTMPSYSRRISTATPYMNGETSTKSLWVINSALRIKILCATYVNVNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQEKKDETQKVQMKFLVEQMRRPDFMDALQGFLSPLNPAHQLGNLRLEECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 14665 - protein, 1102 aa, Homo Sapiens
MELENYKQPVVLREDNCRRRRRMKPRSAAASLSSMELIPIEFVLPTSQRKCKSPETALLHVAGHGNVEQMKAQVWLRALETSVAADFYHRLGPHHFLLLYQKKGQWYEIYDKYQVVQTLDCLRYWKATHRSPGQIHLVQRHPPSEESQAFQRQLTALIGYDVTDVSNVHDDELEFTRRGLVTPRMAEVASRDPKLYAMHPWVTSKPLPEYLWKKIANNCIFIVIHRSTTSQTIKVSPDDTPGAILQSFFTKMAKKKSLMDIPESQSEQDFVLRVCGRDEYLVGETPIKNFQWVRHCLKNGEEIHVVLDTPPDPALDEVRKEEWPLVDDCTGVTGYHEQLTIHGKDHESVFTVSLWDCDRKFRVKIRGIDIPVLPRNTDLTVFVEANIQHGQQVLCQRRTSPKPFTEEVLWNVWLEFSIKIKDLPKGALLNLQIYCGKAPALSSKASAESPSSESKGKVQLLYYVNLLLIDHRFLLRRGEYVLHMWQISGKGEDQGSFNADKLTSATNPDKENSMSISILLDNYCHPIALPKHQPTPDPEGDRVRAEMPNQLRKQLEAIIATDPLNPLTAEDKELLWHFRYESLKHPKAYPKLFSSVKWGQQEIVAKTYQLLARREVWDQSALDVGLTMQLLDCNFSDENVRAIAVQKLESLEDDDVLHYLLQLVQAVKFEPYHDSALARFLLKRGLRNKRIGHFLFWFLRSEIAQSRHYQQRFAVILEAYLRGCGTAMLHDFTQQVQVIEMLQKVTLDIKSLSAEKYDVSSQVISQLKQKLENLQNSQLPESFRVPYDPGLKAGALAIEKCKVMASKKKPLWLEFKCADPTALSNETIGIIFKHGDDLRQDMLILQILRIMESIWETESLDLCLLPYGCISTGDKIGMIEIVKDATTIAKIQQSTVGNTGAFKDEVLNHWLKEKSPTEEKFQAAVERFVYSCAGYCVATFVLGIGDRHNDNIMITETGNLFHIDFGHILGNYKSFLGINKERVPFVLTPDFLFVMGTSGKKTSPHFQKFQDICVKAYLALRHHTNLLIILFSMMLMTGMPQLTSKEDIEYIRDALTVGKNEEDAKKYFLDQIEVCRDKGWTVQFNWFLHLVLGIKQGEKHSA

SEQ ID NO: 14666 - protein, 597 aa, Homo Sapiens
MTSRRWFHPNITGVEAENLLLTRGVDGSFLARPSKSNPGDFTLSVRRNGAVTHIKIQNTGDYYDLYGGEKFATLAELVQYYMEHHGQLKEKNGDVIELKYPLNCADPTSERWFHGHLSGKEAEKLLTEKGKHGSFLVRESQSHPGDFVLSVRTGDDKGESNDGKSKVTHVMIRCQELKYDVGGGERFDSLTDLVEHYKKNPMVETLGTVLQLKQPLNTTRINAAEIESRVRELSKLAETTDKVKQGFWEEFETLQQQECKLLYSRKEGQRQENKNKNRYKNILPFDHTRVVLHDGDPNEPVSDYINANIIMPEFETKCNNSKPKKSYIATQGCLQNTVNDFWRMVFQENSRVIVMTTKEVERGKSKCVKYWPDEYALKEYGVMRVRNVKESAAHDYTLRELKLSKVGQALLQGNTERTVWQYHFRTWPDHGVPSDPGGVLDFLEEVHHKQESIMDAGPVVVHCSAGIGRTGTFIVIDILIDIIREKGVDCDIDVPKTIQMVRSQRSGMVQTEAQYRFIYMAVQHYIETLQRRIEEEQKSKRKGHEYTNIKYSLADQTSGDQSPLPPCTPTPPCAEMREDSARVYENVGLMQQQKSFR

SEQ ID NO: 14667 - protein, 524 aa, Homo Sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQYTVYSQASTMSIPVAMETDGPLFEDVQMLRKTVKDEAHQAQKDPKKDRPLARRKSELPQDPHTKKALEAHCRADELASQDGR

SEQ ID NO: 14668 - protein, 497 aa, Homo Sapiens
METKLPPASTPTSPSSPGLSPVPPPDKVDGFSRRSLRRARPRRSHSSSQFRYQSNQQELTPLPLLKDVPASELHELLSRKLAQCGVMFDFLDCVADLKGKEVKRAALNELVECVGSTRGVLIEPVYPDIIRMISVNIFRTLPPSENPEFDPEEDEPNLEPSWPHLQLVYEFFLRFLESPDFQPSVAKRYVDQKFVLMLLELFDSEDPREREYLKTILHRVYGKFLGLRAYIRKQCNHIFLRFIYEFEHFNGVAELLEILGSIINGFALPLKTEHKQFLVRVLIPLHSVKSLSVFHAQLAYCVVQFLEKDATLTEHVIRGLLKYWPKTCTQKEVMFLGEMEEILDVIEPSQFVKIQEPLFKQVARCVSSPHFQVAERALYFWNNEYILSLIEDNCHTVLPAVFGTLYQVSKEHWNQTIVSLIYNVLKTFMEMNGKLFDELTASYKLEKQQEQQKAQERQELWQGLEELRLRRLQGTQGAKEAPLQRLTPQVAASGGQS

SEQ ID NO: 14669 - protein, 602 aa, Homo Sapiens
MPYKLKKEKEPPKVAKCTAKPSSSGKDGGGENTEEAQPQPQPQPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 14670 - protein, 467 aa, Homo Sapiens
MSSAPTTPPSVDKVDGFSRKSVRKARQKRSQSSSQFRSQGKPIELTPLPLLKDVPSSEQPELFLKKLQQCCVIFDFMDTLSDLKMKEYKRSTLNELVDYITISRGCLTEQTYPEVVRMVSCNIFRTLPPSDSNEFDPEEDEPTLEASWPHLQLVYEFFIRFLESQEFQPSIAKKYIDQKFVLQLLELFDSEDPRERDYLKTVLHRIYGKFLGLRAFIRKQINNIFLRFVYETEHFNGVAELLEILGSIINGFALPLKAEHKQFLVKVLIPLHTVRSLSLFHAQLAYCIVQFLEKDPSLTEPVIRGLMKFWPKTCSQKEVMFLGELEEILDVIEPSQFVKIQEPLFKQIAKCVSSPHFQVAERALYYWNNEYIMSLIEENSNVILPIMFSSLYRISKEHWNPAIVALVYNVLKAFMEMNSTMFDELTATYKSDRQREKKKEKEREELWKKLEDLELKRGLRRDGIIPT

SEQ ID NO: 14671 - protein, 486 aa, Homo Sapiens
MSSSSPPAGAASAAISASEKVDGFTRKSVRKAQRQKRSQGSSQFRSQGSQAELHPLPQLKDATSNEQQELFCQKLQQCCILFDFMDSVSDLKSKEIKRATLNELVEYVSTNRGVIVESAYSDIVKMISANIFRTLPPSDNPDFDPEEDEPTLEASWPHIQLVYEFFLRFLESPDFQPSIAKRYIDQKFVQQLLELFDSEDPRERDFLKTVLHRIYGKFLGLRAFIRKQINNIFLRFIYETEHFNGVAELLEILGSIINGFALPLKAEHKQFLMKVLIPMHTAKGLALFHAQLAYCVVQFLEKDTTLTEPVIRGLLKFWPKTCSQKEVMFLGEIEEILDVIEPTQFKKIEEPLFKQISKCVSSSHFQVAERALYFWNNEYILSLIEENIDKILPIMFASLYKISKEHWNPTIVALVYNVLKTLMEMNGKLFDDLTSSYKAERQREKKKELEREELWKKLEELKLKKALEKQNSAYNMHSILSNTSAE

SEQ ID NO: 14672 - protein, 140 aa, Homo Sapiens
IQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 14673 - protein, 176 aa, Homo Sapiens
DLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 14674 - protein, 164 aa, Homo Sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 14675 - protein, 207 aa, Homo Sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 14676 - protein, 182 aa, Homo Sapiens
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 14677 - protein, 171 aa, Homo Sapiens; identical to SEQ ID NO: 2330

SEQ ID NO: 14678 - protein, 220 aa, Homo Sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 14679 - protein, 355 aa, Homo Sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 14680 - protein, 215 aa, Homo Sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 14681 - protein, 322 aa, Homo Sapiens
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 14682 - protein, 599 aa, Homo Sapiens; identical to SEQ ID NO: 11057

SEQ ID NO: 14683 - protein, 604 aa, Homo Sapiens; identical to SEQ ID NO: 11060

SEQ ID NO: 14684 - protein, 1255 aa, Homo Sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 14685 - protein, 5179 aa, Homo Sapiens
MGLPLARLAAVCLALSLAGGSELQTEGRTRYHGRNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALEGGSHITTFDGKTYTFHGDCYYVLAKGDHNDSYALLGELAPCGSTDKQTCLKTVVLLADKKKNAVVFKSDGSVLLNQLQVNLPHVTASFSVFRPSSYHIMVSMAIGVRLQVQLAPVMQLFVTLDQASQGQVQGLCGNFNGLEGDDFKTASGLVEATGAGFANTWKAQSTCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTSFTTTTTTTTPTSSTVLSTTPKLCCLWSDWINEDHPSSGSDDGDREPFDGVCGAPEDIECRSVKDPHLSLEQHGQKVQCDVSVGFICKNEDQFGNGPFGLCYDYKIRVNCCWPMDKCITTPSPPTTTPSPPPTTTTTLPPTTTPSPPTTTTTTPPPTTTPSPPITTTTTPLPTTTPSPPISTTTTPPPTTTPSPPTTTPSPPTTTPSPPTTTTTTPPPTTTPSPPMTTPITPPASTTTLPPTTTPSPPTTTTTTPPPTTTPSPPTTTPITPPTSTTTLPPTTTPSPPPTTTTTPPPTTTPSPPTTTTPSPPTITTTTPPPTTTPSPPTTTTTTPPPTTTPSPPTTTPITPPTSTTTLPPTTTPSPPPTTTTTPPPTTTPSPPTTTTPSPPITTTTTPPPTTTPSSPITTTPSPPTTTMTTPSPTTTPSSPITTTTTPSSTTTPSPPPTTMTTPSPTTTPSPPTTTMTTLPPTTTSSPLTTTPLPPSITPPTFSPFSTTTPTTPCVPLCNWTGWLDSGKPNFHKPGGDTELIGDVCGPGWAANISCRATMYPDVPIGQLGQTVVCDVSVGLICKNEDQKPGGVIPMAFCLNYEINVQCCECVTQPTTMTTTTTENPTPPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCVKIHNQLISSVSNITCPNFDASICIPGSITFMPNGCCKTCTPRNETRVPCSTVPVTTEVSYAGCTKTVLMNHCSGSCGTFVMYSAKAQALDHSCSCCKEEKTSQREVVLSCPNGGSLTHTYTHIESCQCQDTVCGLPTGTSRRARRSPRHLGSG

SEQ ID NO: 14686 - protein, 3323 aa, Homo Sapiens; identical to SEQ ID NO: 9102

SEQ ID NO: 14687 - protein, 1237 aa, Homo Sapiens
MQLLGLLSILWMLKSSPGATGTLSTATSTSHVTFPRAEATRTALSNSPHSRYLAEWPQGVPQLASPAPGHRENAPMTLTTSPHDTLISETLLSSLVSSNTSTTPTSKFAFKVETTPPTVLVYSATTECVYPTSFIITISHSTSICVTTTQVTFTSSYTPTPVTQKPVTTVTRTYPMTTTEKGTSAMISSPSTTTARETPIVTVTPSSSVSATDTTFHTTISSTTRTTERTPLPTGSIHTTMSPTPVFTTLKTAVTSTSPITSTITSTNTVTSMTTTTSRPTATNTLSSLTSSILSSTPAPNTEVITSHTTTTTPPSTLVTTLPTAIARSTPTSETTPSFMSSIITTETTSHSTPSFSSSTIHSTVSSSTTAITSPFTTAETGVTSTPSSPSSLSTDIPTTSLRTLTPLSLSTSTSLTTTTDLPSIPTDISSLPTPIHIISSSPSIQSTETSSLVGTTSPTMSTVRATLRSTENTPISSFSTSIVVTPETPTTQAPPVLMSATGTQTSPVPTTVTFGSMDSSTSTLHTLTPSTALSKIMSTSQFPIPSTHSSTLQTTPSIPSLQTSLTSTSEFTTESFTRGSTSTNAILTSFSTIIWSSTPTIIMSSSPSSASITPVFATTIHSVPSSPYIFSTENVGSASITAFPSLSSSSTTSTSPTSSSLTTALTEITPFSYISLPSTTPCPGTITITIVPASPTDPCVEMDPSTEATSPPTTPLTVFPFTTEMVTCPSSISMQTTLATHMDTSSMTPESESSIIPNASSSTGTGTVPTNTVFTSTRLPTSETWLSNNSVIPTPLPGVSTIPLTMKPSSSLPTILRTSSKSTHPSPPTARTSQTSVATTQTPTTLTTCRTTPITSWMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDANSCQDSQALCFKPDSIKVNNNSKTELTPEAICRRAAPTGYEEFYFPLVEATRLRCVTKCTSGLDNAIDCHQGQCVLETSGPACRCYSTDTHWFSGPRCEVTVHWRALVGGLTAGAALLVLLLLALGVRAVRSEWWGRQRRGRSWDQDRKWFETWDEEVVGTFSNWGFEDDGTDKDTNFHVALENVDTTMKVHIKRPEMTSSSV

SEQ ID NO: 14688 - protein, 2169 aa, Homo Sapiens
MKGARWRRVPWVSLSCLCLCLLPHVVPGTTEDTLITGSKTAAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 14689 - protein, 5654 aa, Homo Sapiens; identical to SEQ ID NO: 9105

SEQ ID NO: 14690 - protein, 5762 aa, Homo Sapiens; identical to SEQ ID NO: 9106

SEQ ID NO: 14691 - protein, 2439 aa, Homo Sapiens; identical to SEQ ID NO: 9109

SEQ ID NO: 14692 - protein, 377 aa, Homo Sapiens; identical to SEQ ID NO: 9113

SEQ ID NO: 14693 - protein, 5478 aa, Homo Sapiens
MLVIWILTLALRLCASVTTVTPEGSAVHKAISQQGTLWTGEVLEKQTVEQGKSTLRRQKNHFHRSAGELRCRNALKDEGASAGWSVMFAGESVVVLVHLWMTGARVKNLGLVEFASPGDDGDGRAEGFSLGLPLSEQARAAGAREKERQETVINHSTFSGFSQITGSTVNTSIGGNTTSASTPSSSDPFTTFSDYGVSVTFITGSTATKHFLDSSTNSGHSEESTVSHSGPGATGTTLFPSHSATSVFVGEPKTSPITSASMETTALPGSTTTAGLSEKSTTFYSSPRSPDRTLSPARTTSSGVSEKSTTSHSRPGPTHTIAFPDSTTMPGVSQESTASHSIPGSTDTTLSPGTTTPSSLGPESTTFHSSPGYTKTTRLPDNTTTSGLLEASTPVHSSTGSPHTTLSPSSSTTHEGEPTTFQSWPSSKDTSPAPSGTTSAFVKLSTTYHSSPSSTPTTHFSASSTTLGHSEESTPVHSSPVATATTPPPARSATSGHVEESTAYHRSPGSTQTMHFPESSTTSGHSEESATFHGSTTHTKSSTPSTTAALAHTSYHSSLGSTETTHFRDSSTISGRSEESKASHSSPDAMATTVLPAGSTPSVLVGDSTPSPISSGSMETTALPGSTTKPGLSEKSTTFYSSPRSPDTTHLPASMTSSGVSEESTTSHSRPGSTHTTAFPGSTTMPGLSQESTASHSSPGPTDTTLSPGSTTASSLGPEYTTFHSRPGSTETTLLPDNTTASGLLEASMPVHSSTRSPHTTLSPAGSTTRQGESTTFHSWPSSKDTRPAPPTTTSAFVEPSTTSHGSPSSIPTTHISARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSERSTTFHSSPRSPATTLSPASTTSSGVSEESTTSRSRPGSTHTTAFPDSTTTPGLSRHSTTSHSSPGSTDTTLLPASTTTSGPSQESTTSHSSSGSTDTALSPGSTTALSFGQESTTFHSNPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSRGSTETTVFPHSTTTSVHGEEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSDLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPSSKDTMPAPPTTTSAFVELSTTSHGSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRTPTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTTFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTASHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSGPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGSSQESTTSHSSSGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRREEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSTGLQEESTTFQSWPSSSDTTPSPPSTTAVPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSMHTTAFPSSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESNTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSIATTHFPESSTTSGRSEESTASHSSPDTNGITPLPAHFTTSGRIAESTTFYISPGSMETTLASTATTPGLSAKSTILYSSSRSPDQTLSPASMTSSSISGEPTSLYSQAESTHTTAFPASTTTSGLSQESTTFHSKPGSTETTLSPGSITTSSFAQEFTTPHSQPGSALSTVSPASTTVPGLSEESTTFYSSPGSTETTAFSHSNTMSIHSQQSTPFPDSPGFTHTVLPATLTTTDIGQESTAFHSSSDATGTTPLPARSTASDLVGEPTTFYISPSPTYTTLFPASSSTSGLTEESTTFHTSPSFTSTIVSTESLETLAPGLCQEGQIWNGKQCVCPQGYVGYQCLSPLESFPVETPEKLNATLGMTVKVTYRNFTEKMNDASSQEYQNFSTLFKNRMDVVLKGDNLPQYRGVNIRRLLNGSIVVKNDVILEADYTLEYEELFENLAEIVKAKIMNETRTTLLDPDSCRKAILCYSEEDTFVDSSVTPGFDFQEQCTQKAAEGYTQFYYVDVLDGKLACVNKCTKGTKSQMNCNLGTCQLQRSGPRCLCPNTNTHWYWGETCEFNIAKSLVYGIVGAVMAVLLLALIILIILFSLSQRKRHREQYDVPQEWRKEGTPGIFQKTAIWEDQNLRESRFGLENAYNNFRPTLETVDSGTELHIQRPEMVASTV

SEQ ID NO: 14694 - protein, 512 aa, Homo Sapiens; identical to SEQ ID NO: 9095

SEQ ID NO: 14695 - protein, 334 aa, Homo Sapiens
MLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKENRNTGIVFGAILGAILGVSLLTLVGYLLCGKRKTDSFSHRRLYDDRNEPVLRLDNAPEPYDVSFGNSSYYNPTLNDSAMPESEENARDGIPMDDIPPLRTSV

SEQ ID NO: 14696 - protein, 14507 aa, Homo Sapiens
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTYTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWTSVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGSSPAGTSPGSPEMSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLRTLNTLDINLESGTTSSPSWKSSPYERIAPSESTTDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVSWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPEPVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAVANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSLAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHEILTTDEDTTAIEAMHPSTSTAATNVETTSSGHGSQSSVLADSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSSGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSLLTPGQVKTTEVLDASAEPETSSPPSLSSTSVEILATSEVTTDTEKIHPFSNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLDTSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLNPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKTESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILAITEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRIHIPDSDQSTMSPDIITEVITRLSSSSMMSESTQMTITTQKSSPGATAQSTLTLATTTAPLARTHSTVPPRFLHSEMTTLMSRSPENPSWKSSLFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSSPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSVFNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSATAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTTGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMRRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGVITCLICGVLVTTRRRKKEGEYNVQQQCPGYYQSHLDLEDLQ

SEQ ID NO: 14697 - protein, 4493 aa, Homo Sapiens
MPRPGTMALCLLTLVLSLLPPQAAAEQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYGLVGAGVVLMLIILVALLMLVFRSKREVKRQKYRLSQLYKWQEEDSGPAPGTFQNIGFDICQDDDSIHLESIYSNFQPSLRHIDPETKIRIQRPQVMTTSF

SEQ ID NO: 14698 - protein, 8384 aa, Homo Sapiens
MKLILWYLVVALWCFFKDVEALLYRQKSDGKIAASRSGGFSYGSSSSGDLDRKKPLFSLEFGSPGETEDKSRQRQDAGSPKSEDTPAGGFFNSSSSSGDSDRTKPFFSLGLGAPGKAEDKSGDSQDAGGSKSEDTPPGGFFYGSSSSGDSDKKKPLFSFEFGATGEDEDKSRERWDAGNSRSEDSPADSTNTRYGAGFSSSGASLDVGFGWGISDEKGLEVSKADGRETRGSGSAGGETIVFGPDAGSSVGTGSSGLKLGAGKGDAAFGFEVSDSNSFGDTGISSKTVEGNQTSSSGGSVSIDLGDTSFRSENQFVGGGSLNSISNLWDSGQEGFGINEIGGNGMSGSVSAEAGFKGFGSDSSSSGDSSARNGFENSSGISEDSGVILGSSDQHEVELSRTGGNRKRSSDPDEAGNLSPGSDVSDSGGNTWSSDSGSGGGGVTSSSEYSTSGPLNTPEKGSHIPEATPKYSETNAIIGEISTWSKGAYKSFNGRIFFFESSCPYTFCRHCIESGGDFNIEIKRNNDSEIEKITVLIDNNDVSIFGDTILVNGESVQIPYNNKLIHIKKYGEHNVLNSRRGILTLMWDKNNKLSLTLHKQYPTCGLCGNFNSTPGQDINEHIANSKIPGDCPNAVGKSYEVCEDGIQHCNKIIGTYFEKCGKVAALSNDYKMICIDEYCQTRDKTSTCDTYSELSRLCASDGPGTFESWRSDSDVVCGTQRCPEQHIYKECGPSNPATCSNVAPFQDSECVSGCTCPEGYLLDDIGEKGKCVLKAECPCESSGTVYQPGEVREGPCGSQCTCQDAKWSCTEALCPGRCKVEGSSLTTFDGVKYNFPGNCHFLAVHNEDWSISVELRPCPSGQTGTCLNSVTLLLNSSVPVDKYVFNSDGTVTNDKIRNQGYYYSDKIQIFNASSSYLQVETYFHVKLQIQIVPVMQLYVSMPPNQFTDTVGLCGSYNNKAEDDFMSSQNILEKTSQAFANSWEMMSCPKGNPSSCISIEKEKFAERHCGILLDSSGPLASCHPIVNPKPYHEECKKYTCTCENSQDCLCTILGNYVKACAEKETYIVGWRTGLCEHSCPSGLVFKYNVKACNSSCRSLSERDRSCDVEDVPVDGCTCPDAMYQNNEGNCVLKSQCDCYINDEVMQPGKLIHIDDNKCVCRDGILLCQIPIDLTLQNCSGGAEYVDCSDPKAQRRTNRTCSTRNIPVFDENLPCKRGCFCPEGMVRNSKGICVFPNDCPCSFGGREYDEGSVTSVGCNECTCIKGSWSCTQNECQTICHIYGEGHVRTFDGKSYSFDGLCQYSFLEDYCGHENGTFRILTESVPCCEDGLTCSRKIIVAFQDQNIVLQDGKVTAVKSTESKKCELNANAYSIHTVGLYLILKFQNGIIVIWDKNTRLSVILDPNWNGKVCGLCGNNNGDLKDDFTTRYSSVASGALEFGNSWKTSQECSDTVAQTFPCDSNPYCKAWAVRKCEILRDSTFRDCHNKVDPSAYHDACIEEACACDMEGKYLGFCTAVAMYAEACSAVGVCVSWRKPNLCPVYCDYYNAPGECRWHYEPCGTVTAKTCKDQLVGQKFSSLLEGCYAKCPDSAPYLDENTMKCVSLSECSCFYNDVIPAGGVIEDNCGRTCYCIAGQLECSETAPTNSTFAVSTTTATTILSTGAAITLVTGGPSTAASIPAITTSSSETTGTTLGPLTEPFTTGITETSVPIISTSGNAGMTGVVSPTVTGASGMAGTTGGVDAATTGAASENTSERAGTPRVSGETPAVGGGSTPGEAGPGATVSGSTGVSAGSITASPGASATSSESSKSGTTGPSVGGKTGATSSEATSSEGMSGVTGQSLGSTAGSDSEITAKTSFTGSSPPGKLTRPSPGSPGHFSGGTTEWGNVATTGAAGENTSGALGSTEGSVEATTSAGSGNTAGTSGTGDTGPGNTAVSGTPVVSPGATPGAPGSSTPGEADIGNTSFGKSGTPTVSAASTTSSPVSKHTDAASATAVTISGSKPGTPGTPGGATSGGKITSGWSSSGTSTGASNTPGATGSSTGQTDTSGPSAKVTGNYGQSSEIPGTIKSSSDVSGTMGQSDTTSGPSVAVTRTSEQSSGVTVASEPSVGVSGTTGPLAEISGTTRPLVSGLRTTGSSAEGSGTTGPSSRESVTTRPLAEGSGTSGQSVTGSRATGLSATELGTTVSFTGGLGTSRSSARETRTTGPSADGSGTTGPSVVRSGTTRLSVGVTRATESSPGVTGTTTPSAEESRTTGPSVLVTGTTGQSGQGSGTTGKSFIESGPSVVGSGTTGPTSAGLGTTAPSTRRSSTTKPSVGRTGTTGQSGAESGTTEPSARVAGVTGTSAEVSGRIEPSATESSTSRPLGETTGTTIPSMEGSEATGPSVIGSETTRLSVIGSGTTGTSSGGSGATRSSGGGMGTTGQSTARSETTGPLFGLTGTFGQSATVTGTSSNSAGVTTPEKSPGVAMTTGLLVEGSATTQPRILESETTESSAGVIVTSGQSARVTGATGPSAGETGTTEPSTEGSVAAVLFVIGSETTRPLDIGSGTTGTLSGGSSTTRSSDGTTGTTRKSTARSETTGLSGLTGTSGQLAGVTGTSSKSAGVTVTSEKSAGVAVITGSFVERPVTTGPPLLESETTRPSGGVTVTSGQSARVTETVGASAGVTGTTGPSTEGSGATGPSVVGSGTTRPLAGESGTTESSAGVTGTRPSSSRESATTGPSDEGSGTTGLSAGVTVTSGQSVRKTGTTGAPAGVTETTRPSVVKSGTTGPSVIGTRTTGTSSGGSGATRSSGGETETTGQSAVKSGTTESFTRLTRTSGQSAGMTGTSAQSAGVALTSPFVEGLVTTGSSTVGLETTRPSAVGSGKTGPPVVKAQTTGPSAGVTVTSGQSARMTGASGPSVGVTGTTGPASKGLGTIRPSVVGLETTELSAEGSGTTGPPIVGETTVPSAGVTVTSGYSDRVTGATEPLAGVTGTIKPSVAGSVTTGPSVTGVETTAKTTSGGLSTTISSVGGTGTTGQSPERSGTTGPFTGLTGTSAQSAGVTMTSIQSAGVLVTTGLNVDGLGTTGKALIGSGTTGLSAEATGTIGPSTEGLEKTGPSITGSGTTRPLVTESWTAGTSSGGHSTTSPSVRGTETTGQSAAESVTTGPVTGYTETSGPSAGVTVTPRQSPTVTQTTGSSAAVSGTTVQSLTVSGTTRPSSGQTEITGSSVKESGTTESSAVRSGTTGPTAGVTGTNGPSSAGVTGITGSSPGVTGTTGSSPGVTGTTGSSARSGTSIPSVGKTGTTRTSVEESRTTRPSAGITGTNGLSAEVTGTTGPLAGVTGTTGPSAGVTRTTGLSAGETGTTGLSPGVTRTTRSSAGLTGKTGLSAGVTGKTGLSAEVTGTTRLSAGVTGTTGPSPGVTGTTGTPAGVTGTTELSAGVTGKTGLSSEVTETTGLSYGVKRTIGLSAGSTGTSGQSAGVAGTTTLSAEVTGTTRPSAGVTGTTGLSAEVTEITGISAVVTGTTGPSAGVTETTGSSAGVAGTTRLSAGVTGITGLSAGVTGTTGLSTEVTGTTGPSAGATGTTGLSVGVTGITGLSDVVTETTGSSARSGTGIPSVGETRTTSTSVEESRTTRPSAGIMGTNGLPAEVTGTTEPLAGGTGTTGILAGVTGTTGLSAGETGKIGSSAGVTGKTGSSARVTGKTGPSAEVTGKTGLSAGVTGTTGLSPGVTGTSGLSAEVTGTTGPSAEATGLPGVSAGVTGTTGSLAGGTGTIGLSAGVTGTTGSSAGVTGTTGLSAGVTGIAGLSAGVTGITGPSAGVTGTTTVSAGVTGTTGLSAEATEITGLSAGVTGTTGLSAGVTETIRLSAGVTGTIRSSAGVTGITGLSAGVTGTTGPSAGVTGSTGLLAGVTETTGQSAKVTGTTGQSVGVTGTTRSSGGVTGITGLSAGVTGTNGLSAVTGMTGLSAEVTGTTGLSVGVTGIAGLSAGVTGITGPSAGITGTTTISAGVTGTSGLSAEATGITGLSAGVTGKTGLSAGVTETIGLSAEATGTIGSSPGVTGTTGSSTGVTGITGLSAGVTGTTGLSTEVTGTTGPSAGVTRTTGLSAGVTGITGLSAIVTETTGSSARSGTSIPSVGETGTTRTSVEESRTTRPSAGITGTNGLSAEVTGTIGPLAGGTGTTGLSAGVTGTVGSSAVVTGTTGLSAGVTGTTGPSAEETGATGPSAEVTETTGPSAGVTGTGRLSAEVTGTTGPSAEVTGLPGESAEVTGTIGSPAGVTGTTQLSAVVTGITGLSAEVTGTTGLSAGVTGITGLSAEVTRTTGLSAGVTGTIGLSAGVTGTTRPSAGVTGTTGQSAEVTGTTEPSAGLTETTGSSTGVTGATGPLAGVTGTTGISTEVTGTTGPSARVTGTTVLSAGVTGITGLSAIVTETTGSSARSGTSTPSVGETGTTRTSVEESRATRPSAGITGTNGQSAEVTWITGPLAGVTGTTGISAGVTGTTGLSAGVTGTIGSSAVVTGINGLSAGVTGTTGPSAEETGATGPSAEVTGTTGPSAEETGATGPSAEVTGTTGPSGGVTGTNGLSAEVTGTTGPSAEVTGLPGVSAGVTGTIGSPAAVTGTIRPSAVVTGITGLSAEVTGTTGLSAWVTGIAGLSAGVTETIGSSAGVTGTNGLSAEATGTTGPSAGVTGTTGLSAGVTGTAGLSARVTESTGLSAGVTGTTGLSAGVTGTTGPSAGITGTNGLSAEVTGTTGPLAGVTGTIGLSAGVTGIAGLSAGVTESTGLSAGVTGTIRSSAVVTGINGLSAGVTGTTGPSAEETGATGPSAEVTGTTGPSGGVTGTSGISAEVTGTTGPSAEVTGLPGVSAGVTGTIGSPAAVTGTTRPSAVVTGISGLSAEVTGTTGLSAGVTETIGSSAGVTGTNGLSAEATETTGPSAGVTGTTGLSAGVTGTTGPSAGIAGTNGLSAGVTGTTGLSARVTESTGLSAGVTGTIGSSAVVTETTRLSSGVTGTIGPSAEETGATGLSAEVTGTTGSLAEVTGTTGLSAGVTGTIGSSAVVTGTTGLSAGITGTNGLSAEVTGTAGPLAGVTGTTGLSAGVTGTTGLSAGVTETTGQSAGVTESTGLSPGVTGTIGSSAVVTGIKGLSAGVTGTTGPSAEETGATGPSAEVTGTTGPSGGVTGTSVLSVEVTGTTGPSAEVTGLPGVSAGLTGTIGSPAAVRGTTWPSAVVTGISGLSGEVTGTTGLSAGVTGIGGLSAGVTGTIGSSAGVTGTNALSAEATGTTGPSAGVTGTTGLSAGVTGTTGLSAGVTGTIRSSAVVTETTGLSAGVTGTTGPSAGIAGTNGLSAEVTGTTGLSAGMTGTTGLSARVTESTGLSAGVTGTIGSSAVVTETTRLSAGVTGTIGPSAEETGATGLSAEVTRTTGSLAGVTGTTGPSAVVTGKTELSAEVTGTTELSAEVTEKTGPSAEVTGKTGLSAGVMETTGPSAEVTGTTGSSAGVTGTTGPSAGVTGTTGPSAEATGLPGVSAGVTGTIGSPAGVTGTARLSAVVTGISGLSAEVTGTTGLSTGVTGIAGHSAAVTGITRPSAGVTGTTTVSAGVTGTIGLSAEATGITLPSAGVTETTGLSAGVTETIGLSAGVTGTIGSSAGVTEITGLSAGVTGTTGPSAGVTGSTVLSAGVTATTGQSVGVTGTTGPSAGVTGTTGLSAGVTGIAGLSAGVTGITGPSAGVTGTTTVSAGVTGTTGLSAEATEITGLSAGVTGTTGLSAGVTGIAGLSAGVTETIGSSAGVTGTNGLSAEATGKTGPSAGVTGTTGLSAGVTGTTGLSAGVTETIGLSAGVTGTIGSSAGVKGTTGQSAEVTGATGQSVGVTGTTRSSGGVTGITGLSAGLRGTTVSSAKAGTSIPLTGKTGTTRTSVEESTTTGPSAGITGTNGLSAEMTGTNELSAGVTGTIGSSAGVTGTTGLSVEATVTTGLSAGVTGTTVPLAGVTWTPGPSAGVTGIAALSAGVTGKSGLSAGVTGKTGLSAGVTGTTGPSAEATGKTGLSAGVTGITGPFAEVTGTTGLSAGVIGTTGSSAEVTGITGLSAGVTGKTRSSAGVTGTTGLSAKSGTSIPSAGKTGTTKTSVEESRTTRPSAGITATTGVPAATSPGAEGESIASTSVATGAIPRSTIAPGSTTTGTTGVTTGTTLAPRSFNIGTSGGISGKTLKPGSYVSEATTATGTPGAGPSGGTTISSPEVSTISEVSNTGITGVGSETSIETGISNTATTGVAPGTTLAPGSSSTEATTSIGGSASTRGGIATEATGSTRGVRTTGSEAPEGTSGEFSGTTISSGGFHTEATTLTGGRGSIGTESRAESTTSLPQSAKTRGGILTEATSSTGRIRATGSEAPGGTSRKFSGTTISSGGSHTEATTLAGGRDSTESEFRTATIGVVPATTVAPGSSKTEATTFLGVSGTTSVGRATGATTSIAGSDTSQAEHPGGTSGEFPGTTITSGDSHTEATALTGSRGSIGTESTVETTTYIGESGTTRGGLATATTGAFSGKTLEPGNDNTEATGSTGGIRATRTEAPGGTSGEFPGTTFTSGGSHTEATTFTGGKGSTGTESRAATTRAAPGTTLVPGSSNTGATASPGGSATTRGRITTATTGAFSGKTLESENDNTEATSSTRGVRTTRSEAPGGTSGEFPGTRITSGGSYTATTRAAPGTTLAPGSSNTGATASLGGSAMTRGRITTATTGAFSGKTLEPGNNNTEATSSTRGVRTTRSEAPGEATTLTGDRSSTGSESRTATTGVAPGTTVAPGSSKTEATTFLGVSGTTNIGRATGATTSIVGSDTSQAERPGGTTVVSPGASSTSQSSRPGTSVTPDSSASESETVTTKEFSGTTAISRTSHTGTPAASGGQATGSLTATTGVAPGTTVAPGSSNTEATTSVGERETTKAEIITGDTGELSGTTIISENSTTAGITAATGKQAGTSEVAPSTTVAPGSFSTAATTSPGASGTTGVTTTTKTTTSLGGSGTTGAEIKSATTGAPGSRTGTAGVPSATTVSPGSSNSEATTSVGESGKTGAETITEATTSTEGTGTSGTGFKTGTSEVAPATTVAPGSFSTAATTSPGASGMTGVTTTTKTTTSLGGSGTTGAKIKLVGTTTTAPESRTAGVPSGTRVTPGSSNSEATTSVEESRITRAEVITEATTFSGGSGATRAGLPRGTTGEFSGTNFISGSSNTEATTSTEGTGTSGTGFKIAGITSAPGKQAGTSGVSLATTVAPGSFSTATTSSGASGITRAGPTSETTTSLGGSGTTGAEIKSAAVPSGTTVAPGSSNSEATTSVGENGKTRGEIITDTTEGTSGKVLEPGSAHTEATTFPGGSGTTRAGPPGGTTGELSRMTIIPGSSNTEATTSTKGTGTSGTGFKTGTSWVAPGTTVSPGSFSTATISPGASRTTGAAPAAETTTSLEGGGTTGAEIKSGATSGVPGSKTGTAGVPSATTIAPGSSNSEATTSLGESGKTRVETITGTTEGKTLAAGSAHTEATTFSGGSGSTRAGPLGGASGTSGGYVPGRETEPTTSIEETGTSRTIFKTVGITSAPGRQAGTSVVAPSTTVAPGSFSTAATTSPGASGMTGVRTTSKTTTSLGGTGTTRTEIKSGATTGAPGIKTDIMGESSRTTILSGSSNTEATNSIEETGTSGTGFKTAGITAAPGKQAGTSGVAPGTTVAPGSFSTAATTSPGASGVTGTGPTAETTTFLGGSSTTGAEIKSGATTGAPGSKTGTAKVLSGTTVASGSSNSEATTFSGITEAVTVPSKNGSMTTALGSQLSSSQTVIPGSSGTISHTTVAPGSSVTGTTTGASDDQVTGSKTGTTGVALSTTVAPGSSSTEATTSTGVHRTTVVGQKTGATTRGSAKQGTRSTIEATTSFRGTGTTGSGMNTGTTGVVSGNTISPSSFNTEATSGTSERPNPGSEIGTTGIVSGTTVAPGSSNTEATTSLGNGGTTEAGSKIVTTGITTGTTIVPGSFNTKATTSTDVGVATGVGMATGITNIISGRSQPTGSKTGYTVTGSGTTALPGGFRTGNTPGSTGVTSSQEGTTVVSSGITGIPETSISGPSKEASDKTTAPGPPTTVTASTGVKETSETGVQTGSTLVTAGVPTRPQVSQPETTVVATREVETENKTECLASLPPAPVCHGPLGEEKSPGDIWTANCHRGTCTDAKTIDCKPEECPSPPTCKTGEKLVKFQSNDTCCEIGYCEPRTCLFNNTDYEIGASFDDPSNPCVSYSCKDTGFAAVVQDCPKQTWCAEANRIYDSKKCCYTCKNNCRSSLVNVTVIYSGCKKRVQMAKCTGECEKTAKYNYDILLLEHSCLCCREENYELRDIVLDCPDGSTIPYQYKHITTCSCLDICQLYTTFMYS

SEQ ID NO: 14699 - protein, 709 aa, Homo Sapiens; identical to SEQ ID NO: 9097

SEQ ID NO: 14700 - protein, 566 aa, Homo Sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 14701 - protein, 1773 aa, Homo Sapiens
MRRGNISPAFWFLWLLLFGLLGPSSENTTAFTKGSDTTTASITGSETTMASTMASTSALTTGSKITTDSTTGSETTSASTMASTAAFTTGSETNTASTTDSGTTIASTRTFTTGSDTTTGSTAGSETIVASTTVSGTTTTFTIASTTVPETTMASSTTSTAGSEKTMASSIISETTMASTTGSETATVSTTGSETTTTSTASSEATKVSTTGSETTTASTAGSETTTTSTSMAGSEATTTSTADSKVITASSMSSETTVAPAAGSNTTTASTTGSETTTILIKASETTTASTAGSETTTPSPTGSQTTIVSISGSEITTTSTAGSENTTVSSAGSGTTTASMAGSETTVSTAGSETTTVSITGTETTMVSAMGSETTTNSTTSSETTVTSTAGSETTTVSTVGSETTTAYTADSETTAASTTGSEMTTVFTAGSETITPSTAGSETTTVSTAGSETTTVSTTGSETTTASTAHSETTAASTMGSETTKVSTAGSETTVSTAGSETTAASTEDSETNTAFTEDSKTTTASTTGFETTAASTTGSEPTMASTMGSETTMASTIGPETTKVSTASSEVTTVFAAGSETIRASTVGSETTTVSTTGSETTTASIMGSETSTDSTTGSETTTASTEGSETTTASTEGSEATTVSTTGSETTTVSITDSETTTTCTEGSEMTAVSTTVFETTTASTEGSEITIASTSDSETTTASTEGSETTTVTTAGSETKTAYTTGSETTTASNTGLETTTVFTIGSDTTTASTEGSETTAVSATGSEMTTVSTEGSENTTVSTTGSETTTVSTTGLETTTTSTEGSEMTTVSTTGAETTTDSTEGSGTTAASTAGSETTTVSTADSENTTASTADSETTSASTTGSETTTASTTSSETTTASTEGSETTTVSTTDSETTMVSTTGSERTITSTEGSETTTVSATGSETTVSTEGSGTTTVSITGSETTKVSTTGSETTTTSTEGSEITTASITGSETTTASTEGSETTTASTEGSETTSASTTGSETTTASTTSSETTMASIMGSETTMASTIGSETTKVSTASSKMTTVFTENSETTIASTTASETTTVSTAGSETIPASTAGSETTTTTSTEGSETTTASTEGSETTTASTESSETTTATTIGSETTTASTEGSETTTTSTEGSETTTASTEGSEITTVSTTGSETTTASTEGSETTTASTEGSELTTVSTTGSETITVSAEGSETTTVTTMGSETTTASTAGSETTTVSTAGSETTTASIEGSETTTVSSTGSETTTVSTTGTETTITSTEGSETTTVTTAGSETTAVYTTGSETTTTSTEGSETTTVSTTGSETTTASTADLETTTVSTSGSGTTTASTAGSETTTVYITGSKTTTASTEGSEATTVSTTSSETTTASTTGSEMTTVFTTVSETTTVSTIGSEATTSSAAGSEATTTSTEGSETTTASTAGSETTTASTAGSETTTASTSGSETNTACTTGSETSTPSSAGSETNTAFIIGSESTIASTASLEPTATSLTGSETTTVSITASGATAASTTVSSTTFVLTKATDVSIQPITNTPMSGTRTTGTRLTASSSVTMAPGMDFTASAASHTVPGIVLNTSGLGTSTMGASSTTSAHGVRTTTGSTREPTSSTFQETGPVSMGTNTVSMSHTPTNVIKPSGYLQPWAIILISLAAVVAAVGLSVGLSFCLRNLFFPLRYCGIYYPHGHSHSLGLDLNLGLGSGTFHSLGNALVHGGELEMGHGGTHGFGYGVGHGLSHIHGDGYGVNHGGHYGHGGGH

SEQ ID NO: 14702 - protein, 403 aa, Homo Sapiens [sequence omitted]

SEQ ID NO: 14703 - protein, 420 aa, Homo Sapiens
MLHFHYYDTSNKIMEPHRPNVKTAVPLSLESYHISEEYGFLLPDSLKELPDHYRPWMEIANKLPQLIDAHQLQAHVDKMPLLSCQFLKGHREQRLAHLVLSFLTMGYVWQEGEAQPAEVLPRNLALPFVEVSRNLGLPPILVHSDLVLTNWTKKDPDGFLEIGNLETIISFPGGESLHGFILVTALVEKEAVPGIKALVQATNAILQPNQEALLQALQRLRLSIQDITKTLGQMHDYVDPDIFYAGIRIFLSGWKDNPAMPAGLMYEGVSQEPLKYSGGSAAQSTVLHAFDEFLGIRHSKESGDFLYRMRDYMPPSHKAFIEDIHSAPSLRDYILSSGQDHLLTAYNQCVQALAELRSYHITMVTKYLITAAAKAKHGKPNHLPGPPQALKDRGTGGTAVMSFLKSVRDKTLESILHPRG

SEQ ID NO: 14704 - protein, 302 aa, Homo Sapiens
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 14705 - protein, 2347 aa, Homo Sapiens
MKNIYCLIPKLVNFATLGCLWISVVQCTVLNSCLKSCVTNLGQQLDLGTPHNLSEPCIQGCHFWNSVDQKNCALKCRESCEVGCSSAEGAYEEEVLENADLPTAPFASSIGSHNMTLRWKSANFSGVKYIIQWKYAQLLGSWTYTKTVSRPSYVVKPLHPFTEYIFRVVWIFTAQLQLYSPPSPSYRTHPHGVPETAPLIRNIESSSPDTVEVSWDPPQFPGGPILGYNLRLISKNQKLDAGTQRTSFQFYSTLPNTIYRFSIAAVNEVGEGPEAESSITTSSSAVQQEEQWLFLSRKTSLRKRSLKHLVDEAHCLRLDAIYHNITGISVDVHQQIVYFSEGTLIWAKKAANMSDVSDLRIFYRGSGLISSISIDWLYQRMYFIMDELVCVCDLENCSNIEEITPPSISAPQKIVADSYNGYVFYLLRDGIYRADLPVPSGRCAEAVRIVESCTLKDFAIKPQAKRIIYFNDTAQVFMSTFLDGSASHLILPRIPFADVKSFACENNDFLVTDGKVIFQQDALSFNEFIVGCDLSHIEEFGFGNLVIFGSSSQLHPLPGRPQELSVLFGSHQALVQWKPPALAIGANVILISDIIELFELGPSAWQNWTYEVKVSTQDPPEVTHIFLNISGTMLNVPELQSAMKYKVSVRASSPKRPGPWSEPSVGTTLVPASEPPFIMAVKEDGLWSKPLNSFGPGEFLSSDIGNVSDMDWYNNSLYYSDTKGDVFVWLLNGTDISENYHLPSIAGAGALAFEWLGHFLYWAGKTYVIQRQSVLTGHTDIVTHVKLLVNDMVVDSVGGYLYWTTLYSVESTRLNGESSLVLQTQPWFSGKKVIALTLDLSDGLLYWLVQDSQCIHLYTAVLRGQSTGDTTITEFAAWSTSEISQNALMYYSGRLFWINGFRIITTQEIGQKTSVSVLEPARFNQFTIIQTSLKPLPGNFSFTPKVIPDSVQESSFRIEGNASSFQILWNGPPAVDWGVVFYSVEFSAHSKFLASEQHSLPVFTVEGLEPYALFNLSVTPYTYWGKGPKTSLSLRAPETVPSAPENPRIFILPSGKCCNKNEVVVEFRWNKPKHENGVLTKFEIFYNISNQSITNKTCEDWIAVNVTPSVMSFQLEGMSPRCFIAFQVRAFTSKGPGPYADVVKSTTSEINPFPHLITLLGNKIVFLDMDQNQVVWTFSAERVISAVCYTADNEMGYYAEGDSLFLLHLHNRSSSELFQDSLVFDITVITIDWISRHLYFALKESQNGMQVFDVDLEHKVKYPREVKIHNRNSTIISFSVYPLLSRLYWTEVSNFGYQMFYYSIISHTLHRILQPTATNQQNKRNQCSCNVTEFELSGAMAIDTSNLEKPLIYFAKAQEIWAMDLEGCQCWRVITVPAMLAGKTLVSLTVDGDLIYWIITAKDSTQIYQAKKGNGAIVSQVKALRSRHILAYSSVMQPFPDKAFLSLASDTVEPTILNATNTSLTIRLPLAKTNLTWYGITSPTPTYLVYYAEVNDRKNSSDLKYRILEFQDSIALIEDLQPFSTYMIQIAVKNYYSDPLEHLPPGKEIWGKTKNGVPEAVQLINTTVRSDTSLIISWRESHKPNGPKESVRYQLAISHLALIPETPLRQSEFPNGRLTLLVTRLSGGNIYVLKVLACHSEEMWCTESHPVTVEMFNTPEKPYSLVPENTSLQFNWKAPLNVNLIRFWVELQKWKYNEFYHVKTSCSQGPAYVCNITNLQPYTSYNVRVVVVYKTGENSTSLPESFKTKAGVPNKPGIPKLLEGSKNSIQWEKAEDNGCRITYYILEIRKSTSNNLQNQNLRWKMTFNGSCSSVCTWKSKNLKGIFQFRVVAANNLGFGEYSGISENIILVGDDFWIPETSFILTIIVGIFLVVTIPLTFVWHRRLKNQKSAKEGVTVLINEDKELAELRGLAAGVGLANACYAIHTLPTQEEIENLPAFPREKLTLRLLLGSGAFGEVYEGTAVDILGVGSGEIKVAVKTLKKGSTDQEKIEFLKEAHLMSKFNHPNILKQLGVCLLNEPQYIILELMEGGDLLTYLRKARMATFYGPLLTLVDLVDLCVDISKGCVYLERMHFIHRDLAARNCLVSVKDYTSPRIVKIGDFGLARDIYKNDYYRKRGEGLLPVRWMAPESLMDGIFTTQSDVWSFGILIWEILTLGHQPYPAHSNLDVLNYVQTGGRLEPPRNCPDDLWNLMTQCWAQEPDQRPTFHRIQDQLQLFRNFFLNSIYKSRDEANNSGVINESFEGEDGDVICLNSDDIMPVALMETKNREGLNYMVLATECGQGEEKSEGPLGSQESESCGLRKEEKEPHADKDFCQEKQVAYCPSGKPEGLNYACLTHSGYGDGSD

SEQ ID NO: 14706 - protein, 255 aa, Homo Sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 14707 - protein, 254 aa, Homo Sapiens
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 14708 - protein, 241 aa, Homo Sapiens; identical to SEQ ID NO: 13579

SEQ ID NO: 14709 - protein, 199 aa, Homo Sapiens
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 14710 - protein, 1068 aa, Homo Sapiens; identical to SEQ ID NO: 14664

SEQ ID NO: 14711 - protein, 1102 aa, Homo Sapiens; identical to SEQ ID NO: 14665

SEQ ID NO: 14712 - protein, 597 aa, Homo Sapiens; identical to SEQ ID NO: 14666

SEQ ID NO: 14713 - protein, 524 aa, Homo Sapiens; identical to SEQ ID NO: 14667

SEQ ID NO: 14714 - protein, 497 aa, Homo Sapiens; identical to SEQ ID NO: 14668

SEQ ID NO: 14715 - protein, 602 aa, Homo Sapiens; identical to SEQ ID NO: 14669

SEQ ID NO: 14716 - protein, 467 aa, Homo Sapiens; identical to SEQ ID NO: 14670

SEQ ID NO: 14717 - protein, 486 aa, Homo Sapiens; identical to SEQ ID NO: 14671

SEQ ID NO: 14718 - protein, 480 aa, Homo Sapiens [sequence omitted]

SEQ ID NO: 14719 - protein, 619 aa, Homo Sapiens
MPDPAAHLPFFYGSISRAEAEEHLKLAGMADGLFLLRQCLRSLGGYVLSLVHDVRFHHFPIERQLNGTYAIAGGKAHCGPAELCEFYSRDPDGLPCNLRKPCNRPSGLEPQPGVFDCLRDAMVRDYVRQTWKLEGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 14720 - protein, 1132 aa, Homo Sapiens
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 14721 - protein, 233 aa, Homo Sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWDTFVELYGNNAAAESRKGQERFNRWFLTGMTVAGVVLLGSLFSRK

SEQ ID NO: 14722 - protein, 175 aa, Homo Sapiens
MTDCEFGYIYRLAQDYLQCVLQIPQPGSGPSKTSRVLQNVAFSVQKEVEKNLKSCLDNVNVVSVDTARTLFNQVMEKEFEDGIINWGRIVTIFAFEGILIKKLLRQQIAPDVDTYKEISYFVAEFIMNNTGEWIRQNGGWENGFVKKFEPKSGWMTFLEVTGKICEMLSLLKQYC

SEQ ID NO: 14723 - protein, 1102 aa, Homo Sapiens
MFQLPVNNLGSLRKARKTVKKILSDIGLEYCKEHIEDFKQFEPNDFYLKNTTWEDVGLWDPSLTKNQDYRTKPFCCSACPFSSKFFSAYKSHFRNVHSEDFENRILLNCPYCTFNADKKTLETHIKIFHAPNASAPSSSLSTFKDKNKNDGLKPKQADSVEQAVYYCKKCTYRDPLYEIVRKHIYREHFQHVAAPYIAKAGEKSLNGAVPLGSNAREESSIHCKRCLFMPKSYEALVQHVIEDHERIGYQVTAMIGHTNVVVPRSKPLMLIAPKPQDKKSMGLPPRIGSLASGNVRSLPSQQMVNRLSIPKPNLNSTGVNMMSSVHLQQNNYGVKSVGQGYSVGQSMRLGLGGNAPVSIPQQSQSVKQLLPSGNGRSYGLGSEQRSQAPARYSLQSANASSLSSGQLKSPSLSQSQASRVLGQSSSKPAAAATGPPPGNTSSTQKWKICTICNELFPENVYSVHFEKEHKAEKVPAVANYIMKIHNFTSKCLYCNRYLPTDTLLNHMLIHGLSCPYCRSTFNDVEKMAAHMRMVHIDEEMGPKTDSTLSFDLTLQQGSHTNIHLLVTTYNLRDAPAESVAYHAQNNPPVPPKPQPKVQEKADIPVKSSPQAAVPYKKDVGKTLCPLCFSILKGPISDALAHHLRERHQVIQTVHPVEKKLTYKCIHCLGVYTSNMTASTITLHLVHCRGVGKTQNGQDKTNAPSRLNQSPSLAPVKRTYEQMEFPLLKKRKLDDDSDSPSFFEEKPEEPVVLALDPKGHEDDSYEARKSFLTKYFNKQPYPTRREIEKLAASLWLWKSDIASHFSNKRKKCVRDCEKYKPGVLLGFNMKELNKVKHEMDFDAEWLFENHDEKDSRVNASKTADKKLNLGKEDDSSSDSFENLEEESNESGSPFDPVFEVEPKISNDNPEEHVLKVIPEDASESEEKLDQKEDGSKYETIHLTEEPTKLMHNASDSEVDQDDVVEWKDGASPSESGPGSQQVSDFEDNTCEMKPGTWSDESSQSEDARSSKPAAKKKATMQGDREQLKWKNSSYGKVEGFWSKDQSQWKNASENDERLSNPQIEWQNSTIDSEDGEQFDNMTDGVAEPMHGSLAGVKLSSQQA

SEQ ID NO: 14724 - protein, 1131 aa, Homo Sapiens
MFQIPVENLDNIRKVRKKVKGILVDIGLDSCKELLKDLKGFDPGEKYFHNTSWGDVSLWEPSGKKVRYRTKPYCCGLCKYSTKVLTSFKNHLHRYHEDEIDQELVIPCPNCVFASQPKVVGRHFRMFHAPVRKVQNYTVNILGETKSSRSDVISFTCLKCNFSNTLYYSMKKHVLVAHFHYLINSYFGLRTEEMGEQPKTNDTVSIEKIPPPDKYYCKKCNANASSQDALMYHILTSDIHRDLENKLRSVISEHIKRTGLLKQTHIAPKPAAHLAAPANGSAPSAPAQPPCFHLALPQNSPSPAAGQPVTVAQGAPGSLTHSPPAAGQSHMTLVSSPLPVGQNSLTLQPPAPQPVFLSHGVPLHQSVNPPVLPLSQPVGPVNKSVGTSVLPINQTVRPGVLPLTQPVGPINRPVGPGVLPVSPSVTPGVLQAVSPGVLSVSRAVPSGVLPAGQMTPAGQMTPAGVIPGQTATSGVLPTGQMVQSGVLPVGQTAPSRVLPPGQTAPLRVISAGQVVPSGLLSPNQTVSSSAVVPVNQGVNSGVLQLSQPVVSGVLPVGQPVRPGVLQLNQTVGTNILPVNQPVRPGASQNTTFLTSGSILRQLIPTGKQVNGIPTYTLAPVSVTLPVPPGGLATVAPPQMPIQLLPSGAAAPMAGSMPGMPSPPVLVNAAQSVFVQASSSAADTNQVLKQAKQWKTCPVCNELFPSNVYQVHMEVAHKHSESKSGEKLEPEKLAACAPFLKWMREKTVRCLSCKCLVSEEELIHHLLMHGLGCLFCPCTFHDIKGLSEHSRNRHLGKKKLPMDYSNRGFQLDVDANGNLLFPHLDFITILPKEKLGEREVYLAILAGIHSKSLVPVYVKVRPQAEGTPGSTGKRVSTCPFCFGPFVTTEAYELHLKERHHIMPTVHTVLKSPAFKCIHCCGVYTGNMTLAAIAVHLVRCRSAPKDSSSDLQAQPGFIHNSELLLVSGEVMHDSSFSVKRKLPDGHLGAEDQRHGEEQPPILNADAAPGPEKVTSVVPFKRQRNESRTEGPIVKDEALQILALDPKKYEGRSYEEKKQFLKDYFHKKPYPSKKEIELLSSLFWVWKIDVASFFGKRRYICMKAIKNHKPSVLLGFDMSELKNVKHRLNFEYEP

SEQ ID NO: 14725 - protein, 1158 aa, Homo Sapiens; identical to SEQ ID NO: 574

SEQ ID NO: 14726 - protein, 517 aa, Homo Sapiens
MAAAITDMADLEELSRLSPLPPGSPGSAARGRAEPPEEEEEEEEEEEEAEAEAVAALLLNGGSGGGGGGGGGGVGGGEAETMSEPSPESASQAGEDEDEEEDDEEEEDESSSSGGGEEESSAESLVGSSGGSSSDETRSLSPGAASSSSGDGDGKEGLEEPKGPRGSQGGGGGGSSSSSVVSSGGDEGYGTGGGGSSATSGGRRGSLEMSSDGEPLSRMDSEDSISSTIMDVDSTISSGRSTPAMMNGQGSTTSSSKNIAYNCCWDQCQACFNSSPDLADHIRSIHVDGQRGGVFVCLWKGCKVYNTPSTSQSWLQRHMLTHSGDKPFKCVVGGCNASFASQGGLARHVPTHFSQQNSSKVSSQPKAKEESPSKAGMNKRRKLKNKRRRSLPRPHDFFDAQTLDAIRHRAICFNLSAHIESLGKGHSVVFHSTVIAKRKEDSGKIKLLLHWMPEDILPDVWVNESERHQLKTKVVHLSKLPKDTALLLDPNIYRTMPQKRLKRTLIRKVFNLYLSKQ

SEQ ID NO: 14727 - protein, 1210 aa, Homo Sapiens
MAAQSSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKEMTHSWPPPLTAIHTPSTAEPSKFPFPTKDSQHVSSVTQNQKQYDTSSKTHSNSQQGTSSMLEDDLQLSDSEDSDSEQTPEKPPSSSAPPSAPQSLPEPVASAHSSSAESESTSDSDSSSDSESESSSSDSEENEPLETPAPEPEPPTTNKWQLDNWLTKVSQPAAPPEGPRSTEPPRRHPESKGSSDSATSQEHSESKDPPPKSSSKAPRAPPEAPHPGKRSCQKSPAQQEPPQRQTVGTKQPKKPVKASARAGSRTSLQGEREPGLLPYGSRDQTSKDKPKVKTKGRPRAAASNEPKPAVPPSSEKKKHKSSLPAPSKALSGPEPAKDNVEDRTPEHFALVPLTESQGPPHSGSGSRTSGCRQAVVVQEDSRKDRLPLPLRDTKLLSPLRDTPPPQSLMVKITLDLLSRIPQPPGKGSRQRKAEDKQPPAGKKHSSEKRSSDSSSKLAKKRKGEAERDCDNKKIRLEKEIKSQSSSSSSSHKESSKTKPSRPSSQSSKKEMLPPPPVSSSSQKPAKPALKRSRREADTCGQDPPKSASSTKSNHKDSSIPKQRRVEGKGSRSSSEHKGSSGDTANPFPVPSLPNGNSKPGKPQVKFDKQQADLHMREAKKMKQKAELMTDRVGKAFKYLEAVLSFIECGIATESESQSSKSAYSVYSETVDLIKFIMSLKSFSDATAPTQEKIFAVLCMRCQSILNMAMFRCKKDIAIKYSRTLNKHFESSSKVAQAPSPCIASTGTPSPLSPMPSPASSVGSQSSAGSVGSSGVAATISTPVTIQNMTSSYVTITSHVLTAFDLWEQAEALTRKNKEFFARLSTNVCTLALNSSLVDLVHYTRQGFQQLQELTKTP

SEQ ID NO: 14728 - protein, 1311 aa, Homo Sapiens
MDLFDFFRDWDLEQQCHYEQDRSALKKREWERRNQEVQQEDDLFSSGFDLFGEPYKVAEYTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILREMTHSWPTPLTSMHTAGHSEQSTFSIPGQESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 14729 - protein, 1226 aa, Homo Sapiens
MDSFDLALLQEWDLESLCVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDSGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPFGRNELLSPLKDSDEIRSLWVKIDLTLLSRIPEHLPQEPGVLSAPATKDSESAPPSHTSDTPAEKALPKSKRKRKCDNEDDYREIKKSQGEKDSSSRLATSTSNTLSANHCNMNINSVAIPINKNEKMLRSPISPLSDASKHKYTSEDLTSSSRPNGNSLFTSASSSKKPKADSQLQPHGGDLTKAAHNNSENIPLHKSRPQTKPWSPGSNGHRDCKRQKLVFDDMPRSADYFMQEAKRMKHKADAMVEKFGKALNYAEAALSFIECGNAMEQGPMESKSPYTMYSETVELIRYAMRLKTHSGPNATPEDKQLAALCYRCLALLYWRMFRLKRDHAVKYSKALIDYFKNSSKAAQAPSPWGASGKSTGTPSPMSPNPSPASSVGSQGSLSNASALSPSTIVSIPQRIHQMAANHVSITNSILHSYDYWEMADNLAKENREFFNDLDLLMGPVTLHSSMEHLVQYSQQGLHWLRNSAHLS

SEQ ID NO: 14730 - protein, 1163 aa, Homo Sapiens
MNREDRNVLRMKERERRNQEIQQGEDAFPPSSPLFAEPYKVTSKEDKLSSRIQSMLGNYDEMKDFIGDRSIPKLVAIPKPTVPPSADEKSNPNFFEQRHGGSHQSSKWTPVGPAPSTSQSQKRSSGLQSGHSSQRTSAGSSSGTNSSGQRHDRESYNNSGSSSRKKGQHGSEHSKSRSSSPGKPQAVSSLNSSHSRSHGNDHHSKEHQRSKSPRDPDANWDSPSRVPFSSGQHSTQSFPPSLMSKSNSMLQKPTAYVRPMDGQESMEPKLSSEHYSSQSHGNSMTELKPSSKAHLTKLKIPSQPLDASASGDVSCVDEILKEMTHSWPPPLTAIHTPCKTEPSKFPFPTKESQQSNFGTGEQKRYNPSKTSNGHQSKSMLKDDLKLSSSEDSDGEQDCDKTMPRSTPGSNSEPSHHNSEGADNSRDDSSSHSGSESSSGSDSESESSSSDSEANEPSQSASPEPEPPPTNKWQLDNWLNKVNPHKVSPASSVDSNIPSSQGYKKEGREQGTGNSYTDTSGPKETSSATPGRDSKTIQKGSESGRGRQKSPAQSDSTTQRRTVGKKQPKKAEKAAAEEPRGGLKIESETPVDLASSMPSSRHKAATKGSRKPNIKKESKSSPRPTAEKKKYKSTSKSSQKSREIIETDTSSSDSDESESLPPSSQTPKYPESNRTPVKPSSVEEEDSFFRQRMFSPMEEKELLSPLSEPDDRYPLIVKIDLNLLTRIPGKPYKETEPPKGEKKNVPEKHTREAQKQASEKVSNKGKRKHKNEDDNRASESKKPKTEDKNSAGHKPSSNRESSKQSAAKEKDLLPSPAGPVPSKDPKTEHGSRKRTISQSSSLKSSSNSNKETSGSSKNSSSTSKQKKTEGKTSSSSKEVKEKAPSSSSNCPPSAPTLDSSKPRRTKLVFDDRNYSADHYLQEAKKLKHNADALSDRFEKAVYYLDAVVSFIECGNALEKNAQESKSPFPMYSETVDLIKYTMKLKNYLAPDATAADKRLTVLCLRCESLLYLRLFKLKKENALKYSKTLTEHLKNSYNNSQAPSPGLGSKAVGMPSPVSPKLSPGNSGNYSSGASSASASGSSVTIPQKIHQMAASYVQVTSNFLYATEIWDQAEQLSKEQKEFFAELDKVMGPLIFNASIMTDLVRYTRQGLHWLRQDAKLIS

SEQ ID NO: 14731 - protein, 2266 aa, Homo Sapiens
MRDLRAQVTSGLLPFPEVTLQALGEDEITLESVLRGKFAAGKNGLACLACGPQLEVVNSITGERLSAYRFSGVNEQPPVVLAVKEFSWQKRTGLLIGLEETEGSVLCLYDLGISKVVKAVVLPGRVTAIEPIINHGGASASTQHLHPSLRWLFGVAAVVTDVGQILLVDLCLDDLSCNQNEVEASDLEVLTGIPAEVPHIRESVMRQGRHLCFQLVSPTGTAVSTLSYISRTNQLAVGFSDGYLALWNMKSMKREYYIQLESGQVPVYAVTFQEPENDPRNCCYLWAVQSTQDSEGDVLSLHLLQLAFGNRKCLASGQILYEGLEYCEERYTLDLTGGMFPLRGQTSNTKLLGCQSIEKFRSHGDREEGVNEALSPDTSVSVFTWQVNIYGQGKPSVYLGLFDINRWYHAQMPDSLRSGEYLHNCSYFALWSLESVVSRTSPHGILDILVHERSLNRGVPPSYPPPEQFFNPSTYNFDATCLLNSGVVHLTCTGFQKETLTFLKKSGPSLNELIPDGYNRCLVAGLLSPRFVDVQPSSLSQEEQLEAILSAAIQTSSLGLLTGYIRRWITEEQPNSATNLRFVLEWTWNKVVLTKEEFDRLCVPLFDGSCHFMDPQTIQSIQQCYLLLSNLNIVLSCFASEAREITERGLIDLSNKFVVSHLICQYAQVVLWFSHSGLLPEGIDDSVQLSRLCYNYPVIQNYYTSRRQKFERLSRGKWNPDCLMIDGLVSQLGERIEKLWKRDEGGTGKYPPASLHAVLDMYLLDGVTEAAKHSITIYLLLDIMYSFPNKTDTPIESFPTVFAISWGQVKLIQGFWLIDHNDYESGLDLLFHPATAKPLSWQHSKIIQAFMSQGEHRQALRYIQTMKPTVSSGNDVILHLTVLLFNRCMVEAWNFLRQHCNRLNIEELLKHMYEVCQEMGLMEDLLKLPFTDTEQECLVKFLQSSASVQNHEFLLVHHLQRANYVPALKLNQTLKINVMNDRDPRLRERSLARNSILDQYGKILPRVHRKLAIERAKPYHLSTSSVFRLVSRPKPLSAVPKQVVTGTVLTRSVFINNVLSKIGEVWASKEPINSTTPFNSSKIEEPSPIVYSLPAPELPEAFFGTPISKASQKISRLLDLVVQPVPRPSQCSEFIQQSSMKSPLYLVSRSLPSSSQLKGSPQAISRASELHLLETPLVVKKAKSLAMSVTTSGFSEFTPQSILRSTLRSTPLASPSPSPGRSPQRLKETRISFVEEDVHPKWIPGAADDSKLEVFTTPKKCAVPVETEWLKSKDRTTSFFLNSPEKEHQEMDEGSQSLEKLDVSKGNSSVSITSDETTLEYQDAPSPEDLEETVFTASKPKSSSTALTTNVTEQTEKDGDKDVFASEVTPSDLQKQMGNLEDAETKDLLVAAEAFSELNHLSPVQGTEASLCAPSVYEGKIFTQKSKVPVLDEGLTSVETYTPAIRANDNKSMADVLGDGGNSSLTISEGPIVSERRLNQEVALNLKEDHEVEVGVLKESVDLPEEKLPISDSPPDTQEIHVIEQEKLEAQDSGEEARNLSFNELYPSGTLKLQYNFDTIDQQFCDLADNKDTAECDIAEVDGELFVAQSNFTLILEGEEGEVEPGDFASSDVLPKAANTATEEKLVCSGENDNHGQIANLPSAVTSDQKSQKVDTLPYVPEPIKVAIAENLLDVIKDTRSKEITSDTMEQSIHETIPLVSQNIMCPTKLVKSAFKTAQETSTMTMNVSQVDDVVSSKTRTRGQRIQNVNVKSAQQEASADVATPKMPGQSVRKKTRKAKEISEASENIYSDVRGLSQNQQIPQNSVTPRRGRRKKEVNQDILENTSSVEQELQITTGRESKRLKSSQLLEPAVEETTKKEVKVSSVTKRTPRRIKRSVENQESVEIINDLKVSTVTSPSRMIRKLRSTNLDASENTGNKQDDKSSDKQLRIKHVRRVRGREVSPSDVREDSNLESSQLTVQAEFDMSAIPRKRGRPRKINPSEDVGSKAVKEERSPKKKEAPSIRRRSTRNTPAKSENVDVGKPALGKSILVPNEELSMVMSSKKKLTKKTESQSQKRSLHSVSEERTDEMTHKETNEQEERLLATASFTKSSRSSRTRSSKAILLPDLSEPNNEPLFSPASEVPRKAKAKKIEVPAQLKELVSDLSSQFVISPPALRSRQKNTSNKNKLEDELKDDAQSVETLGKPKAKRIRTSKTKQASKNTEKESAWSPPPIEIRLISPLASPADGVKSKPRKTTEVTGTGLGRNRKKLSSYPKQILRRKML

SEQ ID NO: 14732 - protein, 848 aa, Homo Sapiens
MNSSSANITYASRKRRKPVQKTVKPIPAEGIKSNPSKRHRDRLNTELDRLASLLPFPQDVINKLDKLSVLRLSVSYLRAKSFFDVALKSSPTERNGGQDNCRAANFREGLNLQEGEFLLQALNGFVLVVTTDALVFYASSTIQDYLGFQQSDVIHQSVYELIHTEDRAEFQRQLHWALNPSQCTESGQGIEEATGLPQTVVCYNPDQIPPENSPLMERCFICRLRCLLDNSSGFLAMNFQGKLKYLHGQKKKGKDGSILPPQLALFAIATPLQPPSILEIRTKNFIFRTKHKLDFTPIGCDAKGRIVLGYTEAELCTRGSGYQFIHAADMLYCAESHIRMIKTGESGMIVFRLLTKNNRWTWVQSNARLLYKNGRPDYIIVTQRPLTDEEGTEHLRKRNTKLPFMFTTGEAVLYEATNPFPAIMDPLPLRTKNGTSGKDSATTSTLSKDSLNPSSLLAAMMQQDESIYLYPASSTSSTAPFENNFFNESMNECRNWQDNTAPMGNDTILKHEQIDQPQDVNSFAGGHPGLFQDSKNSDLYSIMKNLGIDFEDIRHMQNEKFFRNDFSGEVDFRDIDLTDEILTYVQDSLSKSPFIPSDYQQQQSLALNSSCMVQEHLHLEQQQQHHQKQVVVEPQQQLCQKMKHMQVNGMFENWNSNQFVPFNCPQQDPQQYNVFTDLHGISQEFPYKSEMDSMPYTQNFISCNQPVLPQHSKCTELDYPMGSFEPSPYPTTSSLEDFVTCLQLPENQKHGLNPQSAIITPQTCYAGAVSMYQCQPEPQHTHVGQMQYNPVLPGQQAFLNKFQNGVLNETYPAELNNINNTQTTTHLQPLHHPSEARPFPDLTSSGFL

SEQ ID NO: 14733 - protein, 701 aa, Homo Sapiens
MPRTMIPPGECTYAGRKRRRPLQKQRPAVGAEKSNPSKRHRDRLNAELDHLASLLPFPPDIISKLDKLSVLRLSVSYLRVKSFFQVVQEQSSRQPAAGAPSPGDSCPLAGSAVLEGRLLLESLNGFALVVSAEGTIFYASATIVDYLGFHQTDVMHQNIYDYIHVDDRQDFCRQLHWAMDPPQVVFGQPPPLETGDDAILGRLLRAQEWGTGTPTEYSAFLTRCFICRVRCLLDSTSGFLTMQFQGKLKFLFGQKKKAPSGAMLPPRLSLFCIAAPVLLPSAAEMKMRSALLRAKPRADTAATADAKVKATTSLCESELHGKPNYSAGRSSRESGVLVLREQTDAGRWAQVPARAPCLCLRGGPDLVLDPKGGSGDREEEQHRMLSRASGVTGRRETPGPTKPLPWTAGKHSEDGARPRLQPSKNDPPSLRPMPRGSCLPCPCVQGTFRNSPISHPPSPSPSAYSSRTSRPMRDVGEDQVHPPLCHFPQRSLQHQLPQPGAQRFATRGYPMEDMKLQGVPMPPGDLCGPTLLLDVSIKMEKDSGCEGAADGCVPSQVWLGASDRSHPATFPTRMHLKTEPDSRQQVYISHLGHGVRGAQPHGRATAGRSRELTPFHPAHCACLEPTDGLPQSEPPHQLCARGRGEQSCTCRAAEAAPVVKREPLDSPQWATHSQGMVPGMLPKSALATLVPPQASGCTFLP

SEQ ID NO: 14734 - protein, 545 aa, Homo Sapiens
MATDAALRRLLRLHRTEIAVAVDSAFPLLHALADHDVVPEDKFQETLHLKEKEGCPQAFHALLSWLLTQDSTAILDFWRVLFKDYNLERYGRLQPILDSFPKDVDLSQPRKGRKPPAVPKALVPPPRLPTKRKASEEARAAAPAALTPRGTASPGSQLKAKPPKKPESSAEQQRLPLGNGIQTMSASVQRAVAMSSGDVPGARGAVEGILIQQVFESGGSKKCIQVGGEFYTPSKFEDSGSGKNKARSSSGPKPLVRAKGAQGAAPGGGEARLGQQGSVPAPLALPSDPQLHQKNEDECAVCRDGGELICCDGCPRAFHLACLSPPLREIPSGTWRCSSCLQATVQEVQPRAEEPRPQEPPVETPLPPGLRSAGEEVRGPPGEPLAGMDTTLVYKHLPAPPSAAPLPGLDSSALHPLLCVGPEGQQNLAPGARCGVCGDGTDVLRCTHCAAAFHWRCHFPAGTSRPGTGLRCRSCSGDVTPAPVEGVLAPSPARLAPGPAKDDTASHEPALHRDDLESLLSEHTFDGILQWAIQSMARPAAPFPS

SEQ ID NO: 14735 - protein, 1439 aa, Homo Sapiens
MASSETEIRWAEPGLGKGPQRRRWAWAEDKRDVDRSSSQSWEEERLFPNATSPELLEDFRLAQQHLPPLEWDPHPQPDGHQDSESGETSGEEAEAEDVDSPASSHEPLAWLPQQGRQLDMTEEEPDGTLGSLEVEEAGESSSRLGYEAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSDPPQPNHSIHTGMVPQGTKVLSFTIPQPRSAEWWPGPAEDPQASAASGWPSARGDLSPSSLTSMPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLEEATEKMVSMKPPGFQASLARDGHMSGLGKAEAAPPGPGVPPHPPGTKSAASHQSSMTSLEGSGISERLPQKPLHRGGGPHLEETWMASPETDSGFVGSETSRVSPLTQTPEHRLSHISTAGTLAQPFAASVPRDGASYPKARGSLIPRRATEPSTPRSQAQRYLSSPSGPLRQRAPNFSLERTLAAEMAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKASSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 14736 - protein, 326 aa, Homo Sapiens
MEFLSEKFALKSPPSKNSDFYMGAGGPLEHVMETLDNESFYSKASAGKCVQAFGPLPRAEHHVRLERTSPCQDSSVNYGITKVEGQPLHTELNRAMDNCNSLRMSPVKGMQEKGELDELGDKCDSNVSSSKKRRHRTTFTSLQLEELEKVFQKTHYPDVYVREQLALRTELTEARVQVWFQNRRAKWRKRERYGQIQQAKSHFAATYDISVLPRTDSYPQIQNNLWAGNASGGSVVTSCMLPRDTSSCMTPYSHSPRTDSSYTGFSNHQNQFSHVPLNNFFTDSLLTGATNGHAFETKPEFERRSSSIAVLRMKAKEHTANISWAM

SEQ ID NO: 14737 - protein, 343 aa, Homo Sapiens
MDPEHCAPFRVGPAPGPYVASGDEPPGPQGTPAAAPHLHPAPPRGPRLTRFPACGPLEPYLPEPAKPPAKYLQDLGPGPALNGGHFYEGPAEAEEKTSKAASFPQLPLDCRGGPRDGPSNLQGSPGPCLASLHLPLSPGLPDSMELAKNKSKKRRNRTTFSTFQLEELEKVFQKTHYPDVYAREQLALRTDLTEARVQVWFQNRRAKWRKRERYGKIQEGRNPFTAAYDISVLPRTDSHPQLQNSLWASPGSGSPGGPCLVSPEGIPSPCMSPYSHPHGSVAGFMGVPAPSAAHPGIYSIHGFPPTLGGHSFEPSSDGDYKSPSLVSLRVKPKEPPGLLNWTT

SEQ ID NO: 14738 - protein, 411 aa, Homo Sapiens
MNAETCVSYCESPAAAMDAYYSPVSQSREGSSPFRAFPGGDKFGTTFLSAAAKAQGFGDAKSRARYGAGQQDLATPLESGAGARGSFNKFQPQPSTPQPQPPPQPQPQQQQPQPQPPAQPHLYLQRGACKTPPDGSLKLQEGSSGHSAALQVPCYAKESSLGEPELPPDSDTVGMDSSYLSVKEAGVKGPQDRASSDLPSPLEKADSESNKGKKRRNRTTFTSYQLEELEKVFQKTHYPDVYAREQLAMRTDLTEARVQVWFQNRRAKWRKRERFGQMQQVRTHFSTAYELPLLTRAENYAQIQNPSWLGNNGAASPVPACVVPCDPVPACMSPHAHPPGSGASSVTDFLSVSGAGSHVGQTHMGSLFGAASLSPGLNGYELNGEPDRKTSSIAALRMKAKEHSAAISWAT

SEQ ID NO: 14739 - protein, 726 aa, Homo Sapiens
MSPAPDAAPAPASISLFDLSADAPVFQGLSLVSHAPGEALARAPRTSCSGSGERESPERKLLQGPMDISEKLFCSTCDQTFQNHQEQREHYKLDWHRFNLKQRLKDKPLLSALDFEKQSSTGDLSSISGSEDSDSASEEDLQTLDRERATFEKLSRPPGFYPHRVLFQNAQGQFLYAYRCVLGPHQDPPEEAELLLQNLQSRGPRDCVVLMAAAGHFAGAIFQGREVVTHKTFHRYTVRAKRGTAQGLRDARGGPSHSAGANLRRYNEATLYKDVRDLLAGPSWAKALEEAGTILLRAPRSGRSLFFGGKGAPLQRGDPRLWDIPLATRRPTFQELQRVLHKLTTLHVYEEDPREAVRLHSPQTHWKTVREERKKPTEEEIRKICRDEKEALGQNEESPKQGSGSEGEDGFQVELELVELTVGTLDLCESEVLPKRRRRKRNKKEKSRDQEAGAHRTLLQQTQEEEPSTQSSQAVAAPLGPLLDEAKAPGQPELWNALLAACRAGDVGVLKLQLAPSPADPRVLSLLSAPLGSGGFTLLHAAAAAGRGSVVRLLLEAGADPTVQDSRARPPYTVAADKSTRNEFRRFMEKNPDAYDYNKAQVPGPLTPEMEARQATRKREQKAARRQREEQQQRQQEQEEREREEQRRFAALSDREKRALAAERRLAAQLGAPTSPIPDSAIVNTRRCWSCGASLQGLTPFHYLDFSFCSTRCLQDHRRQAGRPSS

SEQ ID NO: 14740 - protein, 807 aa, Homo Sapiens
MFSAGAESLLHQAREIQDEELKKFCSRICKLLQAEDLGPDTLDSLQRLFLIISATKYSRRLEKTCVDLLQATLGLPACPEQLQVLCAAILREMSPSDSLSLAWDHTQNSRQLSLVASVLLAQGDRNEEVRAVGQGVLRALESRQPEGPSLRHLLPVMAKVVVLSPGTLQEDQATLLSKRLVDWLRYASLQQGLPHSGGFFSTPRARQPGPVTEVDGAVATDFFTVLSSGHRFTDDQWLNVQAFSMLRAWLLHSGPEGPGTLDTDDRSEQEGSTLSVISATSSAGRLLPPRERLREVAFEYCQRLIEQSNRRALRKGDSDLQKACLVEAVLVLDVLCRQDPSFLYRSLSCLKALHGRVRGDPASVRVLLPLAHFFLSHGEAAAVDSEAVYQHLFTRIPVEQFHSPMLAFEFIQFCRDNLHLFSGHLSTLRLSFPNLFKFLAWNSPPLTSEFVALLPALVDAGTALEMLHALLDLPCLTAVLDLQLRSAPAASERPLWDTSLRAPSCLEAFRDPQFQGLFQYLLRPKASGATERLAPLHQLLQPMAGCARVAQCAQAVPTLLQAFFSAVTQVADGSLINQLALLLLGRSDSLYPAPGYAAGVHSVLSSQFLALCTLKPSLVVELARDLLEFLGSVNGLCSRASLVTSVVWAIGEYLSVTYDRRCTVEQINKFFEALEALLFEVTQCRPSAALPRCPPQVVTVLMTTLTKLASRSQDLIPRASLLLSKMRTLAHSPATSSTHSEEGAEAIRTRATELLTLLKMPSVAQFVLTPSTEVCSPRYHRDANTALPLALRTVSRLVEREAGLMPG

SEQ ID NO: 14741 - protein, 920 aa, Homo Sapiens
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 14742 - protein, 315 aa, Homo Sapiens
MRNRMAPENPQPDPFINRNYSNMKVIPPQDPASPSFTLLSKLECSGTVSAYCSLNLPGSTDPPTSASRVAATTAIRRRHKERTSFTHQQYEELEALFSQTMFPDRNLQEKLALRLDLPESTVKVWFRNRRFKLKKQQQQQSAKQRNQILPSKKNVPTSPRTSPSPYAFSPVISDFYSSLPSQPLDPSNWAWNSTFTESSTSDFQMQDTQWERLVASVPALYSDAYDIFQIIELYNLPDENEISSSSFHCLYQYLSPTKYQVGGQGSSLSIFAGPAVGLSPAQTWPNMTSQAFEAYSLTDSLEFQKTSNMVDLGFL

SEQ ID NO: 14743 - protein, 1499 aa, Homo Sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKALQKLQAERDALILKHIHFVYHPTKETCPSCPACVDAKIEHLISSRFIRPSDRNQKNSLSDPNIDRINLVILGKDGLARELANEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIVFYSAKRKASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLCNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGLSTEGIYRVSGNKSEMESLQRQFDQDHNLDLAEKDFTVNTVAGAMKSFFSELPDPLVPYNMQIDLVEAHKINDREQKLHALKEVLKKFPKENHEVFKYVISHLNKVSHNNKVNLMTSENLSICFWPTLMRPDFSTMDALTATRTYQTIIELFIQQCPFFFYNRPITEPPGARPSSPSAVASTVPFLTSTPVTSQPSPPQSPPPTPQSPMQPLLPSQLQAEHTL

SEQ ID NO: 14744 - protein, 2285 aa, Homo Sapiens
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQNYKRPMDGTYGPPAKRHEGEMYSVPYSTGQGQPQQQQLPPAQPQPASQQQAAQPSPQQDVYNQYGNAYPATATAATERRPAGGPQNQFPFQFGRDRVSAPPGTNAQQNMPPQMMGGPIQASAEVAQQGTMWQGRNDMTYNYANRQSTGSAPQGPAYHGVNRTDEMLHTDQRANHEGSWPSHGTRQPPYGPSAPVPPMTRPPPSNYQPPPSMQNHIPQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 14745 - protein, 2236 aa, Homo Sapiens
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 14746 - protein, 1835 aa, Homo Sapiens
MANSTGKAPPDERRKGLAFLDELRQFHHSRGSPFKKIPAVGGKELDLHGLYTRVTTLGGFAKVSEKNQWGEIVEEFNFPRSCSNAAFALKQYYLRYLEKYEKVHHFGEDDDEVPPGNPKPQLPIGAIPSSYNYQQHSVSDYLRQSYGLSMDFNSPNDYNKLVLSLLSGLPNEVDFAINVCTLLSNESKHVMQLEKDPKIITLLLANAGVFDDTLGSFSTVFGEEWKEKTDRDFVKFWKDIVDDNEVRDLISDRNKSHEGTSGEWIWESLFHPPRKLGINDIEGQRVLQIAVILRNLSFEEGNVKLLAANRTCLRFLLLSAHSHFISLRQLGLDTLGNIAAELLLDPVDFKTTHLMFHTVTKCLMSRDRFLKMRGMEILGNLCKAEDNGVLICEYVDQDSYREIICHLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRRLLKRHENNLSVLAISNMEASSTLAKCLYELNFTVQSKEQEKDSEMLQ

SEQ ID NO: 14747 - protein, 593 aa, Homo Sapiens
MKLQAVMETLLQRQQRARQELEARQQLPPDPPAAPPGRARAAPDEDREPESARMQRAQMAALAAMRAAAAGLGHPASPGGSEDGPPGSEEEDAAREGTPGSPGRGREGPGEEHFEDMASDEDMKPKWEEEEMEEDLGEDEEEEEEDYEDEEEEEDEEGLGPPGPASLGTTALFPRKAQPPQAFRGDGVPRVLGGQERPGPGPAHPGGAAHVAPQLQPPDHGDWTYEEQFKQLYELDGDPKRKEFLDDLFSFMQKRGTPVNRIPIMAKQVLDLFMLYVLVTEKGGLVEVINKKLWREITKGLNLPTSITSAAFTLRTQYMKYLYPYECEKRGLSNPNELQAAIDSNRREGRRQSFGGSLFAYSPGGAHGMLSSPKLPVSSLGLAASTNGSSITPAPKIKKEEDSAIPITVPGRLPVSLAGHPVVAAQAAAVQAAAAQAAVAAQAAALEQLREKLESAEPPEKKMALVADEQQRLMQRALQQNFLAMAAQLPMSIRINSQASESRQDSAVNLTGTNGSNSISMSVEINGIMYTGVLFAQPPAPTPTSAPNKGGGGGGGSSSNAGGRGGNTGTSGGQAGPAGLSTPSTSTSNNSLP

SEQ ID NO: 14748 - protein, 561 aa, Homo Sapiens
MEPLQQQQQQQQQQQKQPHLAPLQMDAREKQGQQMREAQFLYAQKLVTQPTLLSATAGRPSGSTPLGPLARVPPTAAVAQVFERGNMNSEPEEEDGGLEDEDGDDEVAEVAEKETQAASKYFHVQKVARQDPRVAPMSNLLPAPGLPPHGQQAKEDHTKDASKASPSVSTAGQPNWNLDEQLKQNGGLAWSDDADGGRGREISRDFAKLYELDGDPERKEFLDDLFVFMQKRGTPINRIPIMAKQILDLYMLYKLVTEKGGLVEIINKKIWREITKGLNLPTSITSAAFTLRTQYMKYLYAYECEKKALSSPAELQAAIDGNRREGRRPSYSSSLFGYSPAAATAAAAAGAPALLSPPKIRFPILGLGSSSGTNTSSPRISPATTLRKGDGAPVTTVPVPNRLAVPVTLASQQAGTRTAALEQLRERLESGEPAEKKASRLSEEEQRLVQQAFQRNFFSMARQLPMKIRINGRAEDRAEASAAALNLTTSSIGSINMSVDIDGTTYAGVLFAQKPVVHLITGSAPQSLGSSASSSSSSHCSPSPTSSRGTPSAEPSTSWSL

SEQ ID NO: 14749 - protein, 412 aa, Homo Sapiens
MEALQKQQAARLAQGVGPLAPACPLLPPQPPLPDHRTLQAPEGALGNVGAEEEEDAEEDEEKREEAGAEEEAAEESRPGAQGPSSPSSQPPGLHPHEWTYEEQFKQLYELDADPKRKEFLDDLFSFMQKRGTPVNRVPIMAKQVLDLYALFRLVTAKGGLVEVINRKVWREVTRGLSLPTTITSAAFTLRTQYMKYLYPYECETRALSSPGELQAAIDSNRREGRRQAYTATPLFGLAGPPPRGAQDPALGPGPAPPATQSSPGPAQGSTSGLPAHACAQLSPSPIKKEESGIPNPCLALPVGLALGPTREKLAPEEPPEKRAVLMGPMDPPRPCMPPSFLPRGKVPLREERLDGPLNLAGSGISSINMALEINGVVYTGVLFARRQPVPASQGPTNPAPPPSTGPPSSILP

SEQ ID NO: 14750 - protein, 1257 aa, Homo Sapiens
MKAADEPAYLTVGTDVSAKYRGAFCEAKIKTVKRLVKVKVLLKQDNTTQLVQDDQVKGPLRVGAIVETRTSDGSFQEAIISKLTDASWYTVVFDDGDERTLRRTSLCLKGERHFAESETLDQLPLTNPEHFGTPVIAKKTNRGRRSSLPVTEDEKEEESSEEEDEDKRRLNDELLGKVVSVVSATERTEWYPALVISPSCNDDITVKKDQCLVRSFIDSKFYSIARKDIKEVDILNLPESELSTKPGLQKASIFLKTRVVPDNWKMDISEILESSSSDDEDGPAEENDEEKEKEAKKTEEEVPEEELDPEERDNFLQQLYKFMEDRGTPINKPPVLGYKDLNLFKLFRLVYHQGGCDNIDSGAVWKQIYMDLGIPILNSAASYNVKTAYRKYLYGFEEYCRSANIQFRTVHHHEPKVKEEKKDLEESMEEALKLDQEMPLTEVKSEPEENIDSNSESEREEIELKSPRGRRRIARDVNSIKKEIEEEKTEDKLKDNDTENKDVDDDYETAEKKENELLLGRKNTPKQKEKKIKKQEDSDKDSDEEEEKSQEREETESKCDSEGEEDEEDMEPCLTGTKVKVKYGRGKTQKIYEASIKSTEIDDGEVLYLVHYYGWNVRYDEWVKADRIIWPLDKGGPKKKQKKKAKNKEDSEKDEKRDEERQKSKRGRPPLKSTLSSNMPYGLSKTANSEGKSDSCSSDSETEDALEKNLINEELSLKDELEKNENLNDDKLDEENPKISAHILKENDRTQMQPLETLKLEVGENEQIVQIFGNKMEKTEEVKKEAEKSPKGKGRRSKTKDLSLEIIKISSFGQNEAGSEPHIEAHSLELSSLDNKNFSSATEDEIDQCVKEKKLKRKILGQSSPEKKIRIENGMEMTNTVSQERTSDCIGSEGMKNLNFEQHFERENEGMPSLIAESNQCIQQLTSERFDSPAEETVNIPLKEDEDAMPLIGPETLVCHEVDLDDLDEKDKTSIEDVAVESSESNSLVSIPPALPPVVQHNFSVASPLTLSQDESRSVKSESDITIEVDSIAEESQEGLCERESANGFETNVASGTCSIIVQERESREKGQKRPSDGNSGLMAKKQKRTPKRTSAAAKNEKNGTGQSSDSEDLPVLDNSSKCTPVKHLNVSKPQKLARSPARISPHIKDGEKDKHREKHPNSSPRTYKWSFQLNELDNMNSTERISFLQEKLQEIRKYYMSLKSEVATIDRRRKRLKKKDREVSHAGASMSSASSDTGMSPSSSSPPQNVLAVECR

SEQ ID NO: 14751 - protein, 1312 aa, Homo Sapiens
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMSVECR

SEQ ID NO: 14752 - protein, 594 aa, Homo Sapiens
MAAPVKGNRKQSTEGDALDPPASPKPAGKQNGIQNPISLEDSPEAGGEREEEQEREEEQAFLVSLYKFMKERHTPIERVPHLGFKQINLWKIYKAVEKLGAYELVTGRRLWKNVYDELGGSPGSTSAATCTRRHYERLVLPYVRHLKGEDDKPLPTSKPRKQYKMAKENRGDDGATERPKKAKEERRMDQMMPGKTKADAADPAPLPSQEPPRNSTEQQGLASGSSVSFVGASGCPEAYKRLLSSFYCKGTHGIMSPLAKKKLLAQVSKVEALQCQEEGCRHGAEPQASPAVHLPESPQSPKGLTENSRHRLTPQEGLQAPGGSLREEAQAGPCPAAPIFKGCFYTHPTEVLKPVSQHPRDFFSRLKDGVLLGPPGKEGLSVKEPQLVWGGDANRPSAFHKGGSRKGILYPKPKACWVSPMAKVPAESPTLPPTFPSSPGLGSKRSLEEEGAAHSGKRLRAVSPFLKEADAKKCGAKPAGSGLVSCLLGPALGPVPPEAYRGTMLHCPLNFTGTPGPLKGQAALPFSPLVIPAFPAHFLATAGPSPMAAGLMHFPPTSFDSALRHRLCPASSAWHAPPVTTYAAPHFFHLNTKL

SEQ ID NO: 14753 - protein, 1188 aa, Homo Sapiens
MEPNSLQWVGSPCGLHGPYIFYKAFQFHLEGKPRILSLGDFFFVRCTPKDPICIAELQLLWEERTSRQLLSSSKLYFLPEDTPQGRNSDHGEDEVIAVSEKVIVKLEDLVKWVHSDFSKWRCGFHAGPVKTEALGRNGQKEALLKYRQSTLNSGLNFKDVLKEKADLGEDEEETNVIVLSYPQYCRYRSMLKRIQDKPSSILTDQFALALGGIAVVSRNPQILYCRDTFDHPTLIENESICDEFAPNLKGRPRKKKPCPQRRDSFSGVKDSNNNSDGKAVAKVKCEARSALTKPKNNHNCKKVSNEEKPKVAIGEECRADEQAFLVALYKYMKERKTPIERIPYLGFKQINLWTMFQAAQKLGGYETITARRQWKHIYDELGGNPGSTSAATCTRRHYERLILPYERFIKGEEDKPLPPIKPRKQENSSQENENKTKVSGTKRIKHEIPKSKKEKENAPKPQDAAEVSSEQEKEQETLISQKSIPEPLPAADMKKKIEGYQEFSAKPLASRVDPEKDNETDQGSNSEKVAEEAGEKGPTPPLPSAPLAPEKDSALVPGASKQPLTSPSALVDSKQESKLCCFTESPESEPQEASFPSFPTTQPPLANQNETEDDKLPAMADYIANCTVKVDQLGSDDIHNALKQTPKVLVVQSFDMFKDKDLTGPMNENHGLNYTPLLYSRGNPGIMSPLAKKKLLSQVSGASLSSSYPYGSPPPLISKKKLIARDDLCSSLSQTHHGQSTDHMAVSRPSVIQHVQSFRSKPSEERKTINDIFKHEKLSRSDPHRCSFSKHHLNPLADSYVLKQEIQEGKDKLLEKRALPHSHMPSFLADFYSSPHLHSLYRHTEHHLHNEQTSKYPSRDMYRESENSSFPSHRHQEKLHVNYLTSLHLQDKKSAAAEAPTDDQPTDLSLPKNPHKPTGKVLGLAHSTTGPQESKGISQFQVLGSQSRDCHPKACRVSPMTMSGPKKYPESLSRSGKPHHVRLENFRKMEGMVHPILHRKMSPQNIGAARPIKRSLEDLDLVIAGKKARAVSPLDPSKEVSGKEKASEQESEGSKAAHGGHSGGGSEGHKLPLSSPIFPGLYSGSLCNSGLNSRLPAGYSHSLQYLKNQTVLSPLMQPLAFHSLVMQRGIFTSPTNSQQLYRHLAAATPVGSSYGDLLHNSIYPLAAINPQAAFPSSQLSSVHPSTKL

SEQ ID NO: 14754 - protein, 789 aa, Homo Sapiens
MAATTANPEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 14755 - protein, 717 aa, Homo Sapiens
MATPAAVNPPEMASDIPGSVTLPVAPMAATGQVRMAGAMPARGGKRRSGMDFDDEDGEGPSKFSRENHSEIERRRRNKMTQYITELSDMVPTCSALARKPDKLTILRMAVSHMKSMRGTGNKSTDGAYKPSFLTEQELKHLILEAADGFLFVVAAETGRVIYVSDSVTPVLNQPQSEWFGSTLYEQVHPDDVEKLREQLCTSENSMTGRILDLKTGTVKKEGQQSSMRMCMGSRRSFICRMRCGNAPLDHLPLNRITTMRKRFRNGLGPVKEGEAQYAVVHCTGYIKAWPPAGMTIPEEDADVGQGSKYCLVAIGRLQVTSSPVCMDMNGMSVPTEFLSRHNSDGIITFVDPRCISVIGYQPQDLLGKDILEFCHPEDQSHLRESFQQVVKLKGQVLSVMYRFRTKNREWMLIRTSSFTFQNPYSDEIEYIICTNTNVKQLQQQQAELEVHQRDGLSSYDLSQVPVPNLPAGVHEAGKSVEKADAIFSQERDPRFAEMFAGISASEKKMMSSASAAGTQQIYSQGSPFPSGHSGKAFSSSVVHVPGVNDIQSSSSTGQNMSQISRQLNQSQVAWTGSRPPFPGQQIPSQSSKTQSSPFGIGTSHTYPADPSSYSPLSSPATSSPSGNAYSSLANRTPGFAESGQSSGQFQGRPSEVWSQWQSQHHGQQSGEQHSHQQPGQTEVFQDMLPMPGDPTQGTGNYNIEDFADLGMFPPFSE

SEQ ID NO: 14756 - protein, 626 aa, Homo Sapiens; identical to SEQ ID NO: 1081

SEQ ID NO: 14757 - protein, 636 aa, Homo Sapiens
MAAEEEAAAGGKVLREENQCIAPVVSSRVSPGTRPTAMGSFSSHMTEFPRKRKGSDSDPSQSGIMTEKVVEKLSQNPLTYLLSTRIEISASSGSRVEDGEHQVKMKAFREAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 14758 - protein, 562 aa, Homo Sapiens
MSNQYQEEGCSERPECKSKSPTLLSSYCIDSILGRRSPCKMRLLGAAQSLPAPLTSRADPEKAVQGSPKSSSAPFEAELHLPPKLRRLYGPGGGRLLQGAAAAAAAAAAAAAAAATATAGPRGEAPPPPPPTARPGERPDGAGAAAAAAAAAAAAWDTLKISQAPQVSISRSKSYRENGAPFVPPPPALDELGGPGGVTHPEERLGVAGGPGSAPAAGGGTGTEDDEEELLEDEEDEDEEEELLEDDEEELLEDDARALLKEPRRCPVAATGAVAAAAAAAVATEGGELSPKEELLLHPEDAEGKDGEDSVCLSAGSDSEEGLLKRKQRRYRTTFTSYQLEELERAFQKTHYPDVFTREELAMRLDLTEARVQVWFQNRRAKWRKREKAGAQTHPPGLPFPGPLSATHPLSPYLDASPFPPHHPALDSAWTAAAAAAAAAFPSLPPPPGSASLPPSGAPLGLSTFLGAAVFRHPAFISPAFGRLFSTMAPLTSASTAAALLRQPTPAVEGAVASGALADPATAAADRRASSIAALRLKAKEHAAQLTQLNILPGTSTGKEVC

SEQ ID NO: 14759 - protein, 236 aa, Homo Sapiens; identical to SEQ ID NO: 1202

SEQ ID NO: 14760 - protein, 193 aa, Homo Sapiens
MDGGTLPRSAPPAPPVPVGCAARRRPASPELLRCSRRRRPATAETGGGAAAVARRNERERNRVKLVNLGFQALRQHVPHGGASKKLSKVETLRSAVEYIRALQRLLAEHDAVRNALAGGLRPQAVRPSAPRGPPGTTPVAASPSRASSSPGRGGSSEPGSPRSAYSSDDSGCEGALSPAERELLDFSSWLGGY

SEQ ID NO: 14761 - protein, 180 aa, Homo Sapiens [sequence omitted]

SEQ ID NO: 14762 - protein, 172 aa, Homo Sapiens
METRKPAERLALPYSLRTAPLGVPGTLPGLPRRDPLRVALRLDAACWEWARSGCARGWQYLPVPLDSAFEPAFLRKRNERERQRVRCVNEGYARLRDHLPRELADKRLSKVETLRAAIDYIKHLQELLERQAWGLEGAAGAVPQRRAECNSDGESKASSAPSPSSEPEEGGS

SEQ ID NO: 14763 - protein, 278 aa, Homo Sapiens
MPMGAAERGAGPQSSAAPWAGSEKAAKRGPSKSWYPRAAASDVTCPTGGDGADPKPGPFGGGLALGPAPRGTMNNNFCRALVDRRPLGPPSCMQLGVMPPPRQAPLPPAEPLGNVPFLLYPGPAEPPYYDAYAGVFPYVPFPGAFGVYEYPFEPAFIQKRNERERQRVKCVNEGYARLRGHLPGALAEKRLSKVETLRAAIRYIKYLQELLSSAPDGSTPPASRGLPGTGPCPAPPATPRPDRPGDGEARAPSSLVPESSESSCFSPSPFLESEESWH

SEQ ID NO: 14764 - protein, 2969 aa, Homo Sapiens
MDPRNTAMLGLGSDSEGFSRKSPSAISTGTLVSKREVELEKNTKEEEDLRKRNRERNIEAGKDDGLTDAQQQFSVKETNFSEGNLKLKIGLQAKRTKKPPKNLENYVCRPAIKTTIKHPRKALKSGKMTDEKNEHCPSKRDPSKLYKKADDVAAIECQSEEVIRLHSQGENNPLSKKLSPVHSEMADYINATPSTLLGSRDPDLKDRALLNGGTSVTEKLAQLIATCPPSKSSKTKPKKLGTGTTAGLVSKDLIRKAGVGSVAGIIHKDLIKKPTISTAVGLVTKDPGKKPVFNAAVGLVNKDSVKKLGTGTTAVFINKNLGKKPGTITTVGLLSKDSGKKLGIGIVPGLVHKESGKKLGLGTVVGLVNKDLGKKLGSTVGLVAKDCAKKIVASSAMGLVNKDIGKKLMSCPLAGLISKDAINLKAEALLPTQEPLKASCSTNINNQESQELSESLKDSATSKTFEKNVVRQNKESILEKFSVRKEIINLEKEMFNEGTCIQQDSFSSSEKGSYETSKHEKQPPVYCTSPDFKMGGASDVSTAKSPFSAVGESNLPSPSPTVSVNPLTRSPPETSSQLAPNPLLLSSTTELIEEISESVGKNQFTSESTHLNVGHRSVGHSISIECKGIDKEVNDSKTTHIDIPRISSSLGKKPSLTSESSIHTITPSVVNFTSLFSNKPFLKLGAVSASDKHCQVAESLSTSLQSKPLKKRKGRKPRWTKVVARSTCRSPKGLELERSELFKNVSCSSLSNSNSEPAKFMKNIGPPSFVDHDFLKRRLPKLSKSTAPSLALLADSEKPSHKSFATHKLSSSMCVSSDLLSDIYKPKRGRPKSKEMPQLEGPPKRTLKIPASKVFSLQSKEEQEPPILQPEIEIPSFKQGLSVSPFPKKRGRPKRQMRSPVKMKPPVLSVAPFVATESPSKLESESDNHRSSSDFFESEDQLQDPDDLDDSHRPSVCSMSDLEMEPDKKITKRNNGQLMKTIIRKINKMKTLKRKKLLNQILSSSVESSNKGKVQSKLHNTVSSLAATFGSKLGQQINVSKKGTIYIGKRRGRKPKTVLNGILSGSPTSLAVLEQTAQQAAGSALGQILPPLLPSSASSSEILPSPICSQSSGTSGGQSPVSSDAGFVEPSSVPYLHLHSRQGSMIQTLAMKKASKGRRRLSPPTLLPNSPSHLSELTSLKEATPSPISESHSDETIPSDSGIGTDNNSTSDRAEKFCGQKKRRHSFEHVSLIPPETSTVLSSLKEKHKHKCKRRNHDYLSYDKMKRQKRKRKKKYPQLRNRQDPDFIAELEELISRLSEIRITHRSHHFIPRDLLPTIFRINFNSFYTHPSFPLDPLHYIRKPDLKKKRGRPPKMREAMAEMPFMHSLSFPLSSTGFYPSYGMPYSPSPLTAAPIGLGYYGRYPPTLYPPPPSPSFTTPLPPPSYMHAGHLLLNPAKYHKKKHKLLRQEAFLTTSRTPLLSMSTYPSVPPEMAYGWMVEHKHRHRHKHREHRSSEQPQVSMDTGSSRSVLESLKRYRFGKDAVGERYKHKEKHRCHMSCPHLSPSKSLINREEQWVHREPSESSPLALGLQTPLQIDCSESSPSLSLGGFTPNSEPASSDEHTNLFTSAIGSCRVSNPNSSGRKKLTDSPGLFSAQDTSLNRLHRKESLPSNERAVQTLAGSQPTSDKPSQRPSESTNCSPTRKRSSSESTSSTVNGVPSRSPRLVASGDDSVDSLLQRMVQNEDQEPMEKSIDAVIATASAPPSSSPGRSHSKDRTLGKPDSLLVPAVTSDSCNNSISLLSEKLTSSCSPHHIKRSVVEAMQRQARKMCNYDKILATKKNLDHVNKILKAKKLQRQARTGNNFVKRRPGRPRKCPLQAVVSMQAFQAAQFVNPELNRDEEGAALHLSPDTVTDVIEAVVQSVNLNPEHKKGLKRKGWLLEEQTRKKQKPLPEEEEQENNKSFNEAPVEIPSPSETPAKPSEPESTLQPVLSLIPREKKPPRPPKKKYQKAGLYSDVYKTTDPKSRLIQLKKEKLEYTPGEHEYGLFPAPIHVVFFVSGKYLRQKRIDFQLPYDILWQWKHNQLYKKPDVPLYKKIRSNVYVDVKPLSGYEATTCNCKKPDDDTRKGCVDDCLNRMIFAECSPNTCPCGEQCCNQRIQRHEWVQCLERFRAEEKGWGIRTKEPLKAGQFIIEYLGEVVSEQEFRNRMIEQYHNHSDHYCLNLDSGMVIDSYRMGNEARFINHSCDPNCEMQKWSVNGVYRIGLYALKDMPAGTELTYDYNFHSFNVEKQQLCKCGFEKCRGIIGGKSQRVNGLTSSKNSQPMATHKKSGRSKEKRKSKHKLKKRRGHLSEEPSENINTPTRLTPQLQMKPMSNRERNFVLKHHVFLVRNWEKIRQKQEEVKHTSDNIHSASLYTRWNGICRDDGNIKSDVFMTQFSALQTARSVRTRRLAAAEENIEVARAARLAQIFKEICDGIISYKDSSRQALAAPLLNLPPKKKNADYYEKISDPLDLITIEKQILTGYYKTVEAFDADMLKVFRNAEKYYGRKSPVGRDVCRLRKAYYNARHEASAQIDEIVGETASEADSSETSVSEKENGHEKDDDVIRCICGLYKDEGLMIQCDKCMVWQHCDCMGVNSDVEHYLCEQCDPRPVDREVPMIPRPHYAQPGCVYFICLLRDDLLLRQGDCVYLMRDSRRTPDGHPVRQSYRLLSHINRDKLDIFRIEKLWKNEKEERFAFGHHYFRPHETHHSPSRRFYHNELFRVPLYEIIPLEAVVGTCCVLDLYTYCKGRPKGVKEQDVYICDYRLDKSAHLFYKIHRNRYPVCTKPYAFDHFPKKLTPKKDFSPHYVPDNYKRNGGRSSWKSERSKPPLKDLGQEDDALPLIEEVLASQEQAANEIPSLEEPEREGATANVSEGEKKTEESSQEPQSTCTPEERRHNQRERLNQILLNLLEKIPGKNAIDVTYLLEEGSGRKLRRRTLFIPENSFRK

SEQ ID NO: 14765 - protein, 628 aa, Homo Sapiens
MAAAGAGPGQEAGAGPGPGAVANATGAEEGEMKPVAAGAAAPPGEGISAAPTVEPSSGEAEGGEANLVDVSGGLETESSNGKDTLEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 14766 - protein, 271 aa, Homo Sapiens
MEDSHKSTTSETAPQPGSAVQGAHISHIAQQVSSLSESEESQDSSDSIGSSQKAHGILARRPSYRKILKDLSSEDTRGRKGDGENSGVSAAVTSMSVPTPIYQTSSGQYIAIAPNGALQLASPGTDGVQGLQTLTMTNSGSTQQGTTILQYAQTSDGQQILVPSNQVVVQTASGDMQTYQIRTTPSATSLPQTVVMTSPVTLTSQTTKTDDPQLKREIRLMKNREAARECRRKKKEYVKCLENRVAVLENQNKTLIEELKTLKDLYSNKSV

SEQ ID NO: 14767 - protein, 505 aa, Homo Sapiens
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 14768 - protein, 181 aa, Homo Sapiens
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIKEGTLQS

SEQ ID NO: 14769 - protein, 351 aa, Homo Sapiens
MTEMSFLSSEVLVGDLMSPFDQSGLGAEESLGLLDDYLEVAKHFKPHGFSSDKAKAGSSEWLAVDGLVSPSNNSKEDAFSGTDWMLEKMDLKEFDLDALLGIDDLETMPDDLLTTLDDTCDLFAPLVQETNKQPPQTVNPIGHLPESLTKPDQVAPFTFLQPLPLSPGVLSSTPDHSFSLELGSEVDITEGDRKPDYTAYVAMIPQCIKEEDTPSDNDSGICMSPESYLGSPQHSPSTRGSPNRSLPSPGVLCGSARPKPYDPPGEKMVAAKVKGEKLDKKLKKMEQNKTAATRYRQKKRAEQEALTGECKELEKKNEALKERADSLAKEIQYLKDLIEEVRKARGKKRVP

SEQ ID NO: 14770 - protein, 282 aa, Homo Sapiens
MSLLATLGLELDRALLPASGLGWLVDYGKLPPAPAPLAPYEVLGGALEGGLPVGGEPLAGDGFSDWMTERVDFTALLPLEPPLPPGTLPQPSPTPPDLEAMASLLKKELEQMEDFFLDAPPLPPPSPPPLPPPPLPPAPSLPLSLPSFDLPQPPVLDTLDLLAIYCRNEAGQEEVGMPPLPPPQQPPPPSPPQPSRLAPYPHPATTRGDRKQKKRDQNKSAALRYRQRKRAEGEALEGECQGLEARNRELKERAESVEREIQYVKDLLIEVYKARSQRTRSC

SEQ ID NO: 14771 - protein, 670 aa, Homo Sapiens
MGEPAGVAGTMESPFSPGLFHRLDEDWDSALFAELGYFTDTDELQLEAANETYENNFDNLDFDLDLMPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININENVINGQDYEVMMQIDCQVMDTRILHIKSSSVPPYLRDQQRNQTNTFFGSPPAATEATHVVSTIPESLQ

SEQ ID NO: 14772 - protein, 703 aa, Homo Sapiens
MAELMLLSEIADPTRFFTDNLLSPEDWGLQNSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRDHLLLPAISHNKTSRPKMSLVMPAMAPNETLSGRGAPGDYEEMMQIECEVMDTRVIHIKTSTVPPSLRKQPSPTPGNATGGPLPVSAASQAHQASHQPLYLNHP

SEQ ID NO: 14773 - protein, 494 aa, Homo Sapiens
MGDDRPFVCNAPGCGQRFTNEDHLAVHKHKHEMTLKFGPARTDSVIIADQTPTPTRFLKNCEEVGLFNELASSFEHEFKKAADEDEKKARSRTVAKKLVAAAGPLDMSLPSTPDIKIKEEEPVEVDSSPPDSPASSPCSPPLKEKEVTPKPVLISTPTPTIVRPGSLPLHLGYDPLHPTLPSPTSVITQAPPSNRQMGSPTGSLPLVMHLANGQTMPVLPGPPVQMPSVISLARPVSMVPNIPGIPGPPVNSSGSISPSGHPIPSEAKMRLKATLTHQVSSINGGCGMVVGTASTMVTARPEQSQILIQHPDAPSPAQPQVSPAQPTPSTGGRRRRTVDEDPDERRQRFLERNRAAASRCRQKRKLWVSSLEKKAEELTSQNIQLSNEVTLLRNEVAQLKQLLLAHKDCPVTALQKKTQGYLESPKESSEPTGSPAPVIQHSSATAPSNGLSVRSAAEAVATSVLTQMASQRTELSMPIQSHVIMTPQSQSAGR

SEQ ID NO: 14774 - protein, 354 aa, Homo Sapiens
MSRLLHAEEWAEVKELGDHHRQPQPHHLPQPPPPPQPPATLQAREHPVYPPELSLLDSTDPRAWLAPTLQGICTARAAQYLLHSPELGASEAAAPRDEVDGRGELVRRSSGGASSSKSPGPVKVREQLCKLKGGVVVDELGCSRQRAPSSKQVNGVQKQRRLAANARERRRMHGLNHAFDQLRNVIPSFNNDKKLSKYETLQMAQIYINALSELLQTPSGGEQPPPPPASCKSDHHHLRTAASYEGGAGNATAAGAQQASGGSQRPTPPGSCRTRFSAPASAGGYSVQLDALHFSTFEDSALTAMMAQKNLSPSLPGSILQPVQEENSKTSPRSHRSDGEFSPHSHYSDSDEAS

SEQ ID NO: 14775 - protein, 152 aa, Homo Sapiens
MKSCKPSGPPAGARVAPPCAGGTECAGTCAGAGRLESAARRRLAANARERRRMQGLNTAFDRLRRVVPQWGQDKKLSKYETLQMALSYIMALTRILAEAERFGSERDWVGLHCEHFGRDHYLPFPGAKLPGESELYSQRLFGFQPEPFQMAT

SEQ ID NO: 14776 - protein, 321 aa, Homo Sapiens
MKHIPVLEDGPWKTVCVKELNGLKKLKRKGKEPARRANGYKTFRLDLEAPEPRAVATNGLRDRTHRLQPVPVPVPVPVPVAPAVPPRGGTDTAGERGGSRAPEVSDARKRCFALGAVGPGLPTPPPPPPPAPQSQAPGGPEAQPFREPGLRPRILLCAPPARPAPSAPPAPPAPPESTVRPAPPTRPGESSYSSISHVIYNNHQDSSASPRKRPGEATAASSEIKALQQTRRLLANARERTRVHTISAAFEALRKQVPCYSYGQKLSKLAILRIACNYILSLARLADLDYSADHSNLSFSECVQRCTRTLQAEGRAKKRKE

SEQ ID NO: 14777 - protein, 2492 aa, Homo Sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKGLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 14778 - protein, 892 aa, Homo Sapiens
MSERAADDVRGEPRRAAAAAGGAAAAAARQQQQQQQQQQPPPPQPQRQQHPPPPPRRTRPEDGGPGAASTSAAAMATVGERRPLPSPEVMLGQSWNLWVEASKLPGKDGTELDESFKEFGKNREVMGLCREDMPIFGFCPAHDDFYLVVCNDCNQVVKPQAFQSHYERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPRPPGCPAQQGGSAPIDPPPVHESPHPPLPATEPASRLSSEEGEGDDKEESVEKLDCHYSGHHPQPASFCTFGSRQIGRGYYVFDSRWNRLRCALNLMVEKHLNAQLWKKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMESFRKNCVAHSGPPYPSTVTSSHSIGLNCVTNKANAVNVRHDQSGRGPPTGSPAESIKRMSVMVNSSDSTLSLGPFIHQSNELPVNSHGSFSHSHTPLDKLIGKKRKCSPSSSSINNSSSKPTKVAKVPAVNNVHMKHTGTIPGAQGLMNSSLLHQPKARP

SEQ ID NO: 14779 - protein, 736 aa, Homo Sapiens
MSLSENSVFAYESSVHSTNVLLSLNDQRKKDVLCDVTIFVEGQRFRAHRSVLAACSSYFHSRIVGQADGELNITLPEEVTVKGFEPLIQFAYTAKLILSKENVDEVCKCVEFLSVHNIEESCFQFLKFKFLDSTADQQECPRKKCFSSHCQKTDLKLSLLDQRDLETDEVEEFLENKNVQTPQCKLRRYQGNAKASPPLQDSASQTYESMCLEKDAALALPSLCPKYRKFQKAFGTDRVRTGESSVKDIHASVQPNERSENECLGGVPECRDLQVMLKCDESKLAMEPEETKKDPASQCPTEKSEVTPFPHNSSIDPHGLYSLSLLHTYDQYGDLNFAGMQNTTVLTEKPLSGTDVQEKTFGESQDLPLKSDLGTREDSSVASSDRSSVEREVAEHLAKGFWSDICSTDTPCQMQLSPAVAKDGSEQISQKRSECPWLGIRISESPEPGQRTFTTLSSVNCPFISTLSTEGCSSNLEIGNDDYVSEPQQEPCPYACVISLGDDSETDTEGDSESCSAREQECEVKLPFNAQRIISLSRNDFQSLLKMHKLTPEQLDCIHDIRRRSKNRIAAQRCRKRKLDCIQNLESEIEKLQSEKESLLKERDHILSTLGETKQNLTGLCQKVCKEAALSQEQIQILAKYSAADCPLSFLISEKDKSTPDGELALPSIFSLSDRPPAVLPPCARGNSEPGYARGQESQQMSTATSEQAGPAEQCRQSGGISDFCQQMTDKCTTDE

SEQ ID NO: 14780 - protein, 1249 aa, Homo Sapiens
MSSMWSEYTIGGVKIYFPYKAYPSQLAMMNSILRGLNSKQHCLLESPTGSGKSLALLCSALAWQQSLSGKPADEGVSEKAEVQLSCCCACHSKDFTNNDMNQGTSRHFNYPSTPPSERNGTSSTCQDSPEKTTLAAKLSAKKQASIYRDENDDFQVEKKRIRPLETTQQIRKRHCFGTEVHNLDAKVDSGKTVKLNSPLEKINSFSPQKPPGHCSRCCCSTKQGNSQESSNTIKKDHTGKSKIPKIYFGTRTHKQIAQITRELRRTAYSGVPMTILSSRDHTCVHPEVVGNFNRNEKCMELLDGKNGKSCYFYHGVHKISDQHTLQTFQGMCKAWDIEELVSLGKKLKACPYYTARELIQDADIIFCPYNYLLDAQIRESMDLNLKEQVVILDEAHNIEDCARESASYSVTEVQLRFARDELDSMVNNNIRKKDHEPLRAVCCSLINWLEANAEYLVERDYESACKIWSGNEMLLTLHKMGITTATFPILQGHFSAVLQKEEKISPIYGKEEAREVPVISASTQIMLKGLFMVLDYLFRQNSRFADDYKIAIQQTYSWTNQIDISDKNGLLVLPKNKKRSRQKTAVHVLNFWCLNPAVAFSDINGKVQTIVLTSGTLSPMKSFSSELGVTFTIQLEANHIIKNSQVWVGTIGSGPKGRNLCATFQNTETFEFQDEVGALLLSVCQTVSQGILCFLPSYKLLEKLKERWLSTGLWHNLELVKTVIVEPQGGEKTNFDELLQVYYDAIKYKGEKDGALLVAVCRGKVSEGLDFSDDNARAVITIGIPFPNVKDLQVELKRQYNDHHSKLRGLLPGRQWYEIQAYRALNQALGRCIRHRNDWGALILVDDRFRNNPSRYISGLSKWVRQQIQHHSTFESALESLAEFSKKHQKVLNVSIKDRTNIQDNESTLEVTSLKYSTPPYLLEAASHLSPENFVEDEAKICVQELQCPKIITKNSPLPSSIISRKEKNDPVFLEEAGKAEKIVISRSTSPTFNKQTKRVSWSSFNSLGQYFTGKIPKATPELGSSENSASSPPRFKTEKMESKTVLPFTDKCESSNLTVNTSFGSCPQSETIISSLKIDATLTRKNHSEHPLCSEEALDPDIELSLVSEEDKQSTSNRDFETEAEDESIYFTPELYDPEDTDEEKNDLAETDRGNRLANNSDCILAKDLFEIRTIKEVDSAREVKAEDCIDTKLNGILHIEESKIDDIDGNVKTTWINELELGKTHEIEIKNFKPSPSKNKGMFPGFK

SEQ ID NO: 14781 - protein, 841 aa, Homo Sapiens
MSVDEKPDSPMYVYESTVHCTNILLGLNDQRKKDILCDVTLIVERKEFRAHRAVLAACSEYFWQALVGQTKNDLVVSLPEEVTARGFGPLLQFAYTAKLLLSRENIREVIRCAEFLRMHNLEDSCFSFLQTQLLNSEDGLFVCRKDAACQRPHEDCENSAGEEEDEEEETMDSETAKMACPRDQMLPEPISFEAAAIPVAEKEEALLPEPDVPTDTKESSEKDALTQYPRYKKYQLACTKNVYNASSHSTSGFASTFREDNSSNSLKPGLARGQIKSEPPSEENEEESITLCLSGDEPDAKDRAGDVEMDRKQPSPAPTPTAPAGAACLERSRSVASPSCLRSLFSITKSVELSGLPSTSQQHFARSPACPFDKGITQGDLKTDYTPFTGNYGQPHVGQKEVSNFTMGSPLRGPGLEALCKQEGELDRRSVIFSSSACDQVSTSVHSYSGVSSLDKDLSEPVPKGLWVGAGQSLPSSQAYSHGGLMADHLPGRMRPNTSCPVPIKVCPRSPPLETRTRTSSSCSSYSYAEDGSGGSPCSLPLCEFSSSPCSQGARFLATEHQEPGLMGDGMYNQVRPQIKCEQSYGTNSSDESGSFSEADSESCPVQDRGQEVKLPFPVDQITDLPRNDFQMMIKMHKLTSEQLEFIHDVRRRSKNRIAAQRCRKRKLDCIQNLECEIRKLVCEKEKLLSERNQLKACMGELLDNFSCLSQEVCRDIQSPEQIQALHRYCPVLRPMDLPTASSINPAPLGAEQNIAASQCAVGENVPCCLEPGAAPPGPPWAPSNTSENCTSGRRLEGTDPGTFSERGPPLEPRSQTVTVDFCQEMTDKCTTDEQPRKDYT

SEQ ID NO: 14782 - protein, 327 aa, Homo Sapiens
MEGSNGFGIDSILSHRAGSPALPKGDPLLGDCRSPLELSPRSESSSDCSSPASPGRDCLETGTPRPGGASGPGLDSHLQPGQLSAPAQSRTVTSSFLIRDILADCKPLAACAPYSSSGQPAAPEPGGRLAAKAAEDFRDKLDKSGSNASSDSEYKVKEEGDREISSSRDSPPVRLKKPRKARTAFTDHQLAQLERSFERQKYLSVQDRMELAASLNLTDTQVKTWYQNRRTKWKRQTAVGLELLAEAGNYSALQRMFPSPYFYPQSLVSNLDPGAALYLYRGPSAPPPALQRPLVPRILIHGLQGASEPPPPLPPLAGVLPRAAQPR

SEQ ID NO: 14783 - protein, 387 aa, Homo Sapiens
MTMEGASGSSFGIDTILSSASSGSPGMMNGDFRPLGEARTADFRSQATPSPCSEIDTVGTAPSSPISVTMEPPEPHLVADATQHHHHLHHSQQPPPPAAAPTQSLQPLPQQQQPLPPQQPPPPPPQQLGSAASAPRTSTSSFLIKDILGDSKPLAACAPYSTSVSSPHHTPKQESNAVHESFRPKLEQEDSKTKLDKREDSQSDIKCHGTKEEGDREITSSRESPPVRAKKPRKARTAFSDHQLNQLERSFERQKYLSVQDRMDLAAALNLTDTQVKTWYQNRRTKWKRQTAVGLELLAEAGNYSALQRMFPSPYFYHPSLLGSMDSTTAAAAAAAMYSSMYRTPPAPHPQLQRPLVPRVLIHGLGPGGQPALNPLSSPIPGTPHPR

SEQ ID NO: 14784 - protein, 254 aa, Homo Sapiens
MQRPGEPGAARFGPPEGCADHRPHRYRSFMIEEILTEPPGPKGAAPAAAAAAAGELLKFGVQALLAARPFHSHLAVLKAEQAAVFKFPLAPLGCSGLSSALLAAGPGLPGAAGAPHLPLELQLRGKLEAAGPGEPGTKAKKGRRSRTVFTELQLMGLEKRFEKQKYLSTPDRIDLAESLGLSQLQVKTWYQNRRMKWKKIVLQGGGLESPTKPKGRPKKNSIPTSEQLTEQERAKDAEKPAEVPGEPSDRSRED

SEQ ID NO: 14785 - protein, 279 aa, Homo Sapiens
MHCHAELRLSSPGQLKAARRRYKTFMIDEILSKETCDYFEKLSLYSVCPSLVVRPKPLHSCTGSPSLRAYPLLSVITRQPTVISHLVPATPGIAQALSCHQVTEAVSAEAPGGEALASSESETEQPTPRQKKPRRSRTIFTELQLMGLEKKFQKQKYLSTPDRLDLAQSLGLTQLQVKTWYQNRRMKWKKMVLKGGQEAPTKPKGRPKKNSIPTSEEIEAEEKMNSQAQGQEQLEPSQGQEELCEAQEPKARDVPLEMAEPPDPPQELPIPSSEPPPLS

SEQ ID NO: 14786 - protein, 125 aa, Homo Sapiens
MPHSSDSSDSSFSRSPPPGKQDSSDDVRRVQRREKNRIAAQKSRQRQTQKADTLHLESEDLEKQNAALRKEIKQLTEELKYFTSVLNSHEPLCSVLAASTPSPPEVVYSAHAFHQPHVSSPRFQP

SEQ ID NO: 14787 - protein, 274 aa, Homo Sapiens
MHLCGGNGLLTQTDPKEQQRQLKKQKNRAAAQRSRQKHTDKADALHQQHESLEKDNLALRKEIQSLQAELAWWSRTLHVHERLCPMDCASCSAPGLLGCWDQAEGLLGPGPQGQHGCREQLELFQTPGSCYPAQPLSPGPQPHDSPSLLQCPLPSLSLGPAVVAEPPVQLSPSPLLFASHTGSSLQGSSSKLSALQPSLTAQTAPPQPLELEHPTRGKLGSSPDNPSSALGLARLQSREHKPALSAATWQGLVVDPSPHPLLAFPLLSSAQVHF

SEQ ID NO: 14788 - protein, 127 aa, Homo Sapiens
MSQGLPAAGSVLQRSVAAPGNQPQPQPQQQSPEDDDRKVRRREKNRVAAQRSRKKQTQKADKLHEEYESLEQENTMLRREIGKLTEELKHLTEALKEHEKMCPLLLCPMNFVPVPPRPDPVAGCLPR

SEQ ID NO: 14789 - protein, 941 aa, Homo Sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMPQLNFGMADPTQMGGLSMLLLAGEHALGTPEVSSGTCRPDVSESPELRQKSPLFQFAEISSSTSHSDASTKQCQTSALFQFAEISSNTSQLGGAEPVKRCGKSALFQLAEMCLASEGMKMEESKLIKAKESDGGRIKELEKGKEEKEIKMEKTDETRLQKEAEFEKSAKENLRDSKELRNFEALQIDDIMAIKMEDPKEIRKEELEEDHKCSHFPDFSYSASSKIIISDVPSRKDHMCHPHGIMIIEDPAALNKPEKLKKKKKKSKMDRHGNDKSTPKKTCKKRQSSESDIESVIYTIEAVAKGDWGIEKLGDTPRKKVRTSSSGKGSILDAKPPKKKVKSREKKMSKEKSSDTTKESRPPDFISISASKNISGETPEGIKAEPLTPMEDALPPSLSGQAKPEDSDCHRKIETCGSRKSERSCKGALYKTLVSEGMLTSLRANVDRGKRSSGKGNSSDHEGCWNEESWTFSQSGTSGSKKFKKTKPKEDCLLGSAKLDEEFEKKFNSLPQYSPVTFDRKCVPVPRKKKKTGNVSSEPTKTSKGPFQSQKKNLFHKIVSKYKHKKEKPNVPEKGSGDKWSNKQLFLDAIHPTEAIFSEDRNTMEPVHKVKNIPSIFNTPEPTTTQEPLVGSQKRKARKTKITHLVRTADGRVSPAGGTLDDKPKEQLQRSLPKATETDCNDKCSHNTEVGETRSSTPEMPAVSAFFSLAALAEVAAMENVHRGQRSTPLTHDGQPKEMPQAPVLISCADQ

SEQ ID NO: 14790 - protein, 835 aa, Homo Sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVGKDVYKCEICKMPFSVYSTLEKHMKKWHSDRVLNNDIKTE

SEQ ID NO: 14791 - protein, 894 aa, Homo Sapiens
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGPCRPAQLPAVAPIAASSHPHSSVITSPLRALGALPPCLPLPCCSARPVSGDGTQGEGQTEAPFGCQCQLSGKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 14792 - protein, 454 aa, Homo Sapiens
MPRCPAGAMDEGPVDLRTRPKAAGLPGAALPLRKRPLRAPSPEPAAPRGAAGLVVPLDPLRGGCDLPAVPGPPHGLARPEALYYPGALLPLYPTRAMGSPFPLVNLPTPLYPMMCPMEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGRSPLIHAVENNSLSMVQLLLQHGANVNAQMYSGSSALHSASGRGLLPLVRTLVRSGADSSLKNCHNDTPLMVARSRRVIDILRGKATRPASTSQPDPSPDRSANTSPESSSRLSSNGLLSASPSSSPSQSPPRDPPGFPMAPPNFFLPSPSPPAFLPFAGVLRGPGRPVPPSPAPGGS

SEQ ID NO: 14793 - protein, 706 aa, Homo Sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 14794 - protein, 479 aa, Homo Sapiens
MGSPAAPEGALGYVREFTRHSSDVLGNLNELRLRGILTDVTLLVGGQPLRAHKAVLIACSGFFYSIFRGRAGVGVDVLSLPGGPEARGFAPLLDFMYTSRLRLSPATAPAVLAAATYLQMEHVVQACHRFIQASYEPLGISLRPLEAEPPTPPTAPPPGSPRRSEGHPDPPTESRSCSQGPPSPASPDPKACNWKKYKYIVLNSQASQAGSLVGERSSGQPCPQARLPSGDEASSSSSSSSSSSEEGPIPGPQSRLSPTAATVQFKCGAPASTPYLLTSQAQDTSGSPSERARPLPGSEFFSCQNCEAVAGCSSGLDSLVPGDEDKPYKCQLCRSSFRYKGNLASHRTVHTGEKPYHCSICGARFNRPANLKTHSRIHSGEKPYKCETCGSRFVQVAHLRAHVLIHTGEKPYPCPTCGTRFRHLQTLKSHVRIHTGEKPYHCDPCGLHFRHKSQLRLHLRQKHGAATNTKVHYHILGGP

SEQ ID NO: 14795 - protein, 920 aa, Homo Sapiens
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 14796 - protein, 189 aa, Homo Sapiens
MKTKNRPPRRRAPVQDTEATPGEGTPDGSLPNPGPEPAKGLRSRPARAAARAPGEGRRRRPGPSGPGGRRDSSIQRRLESNERERQRMHKLNNAFQALREVIPHVRADKKLSKIETLTLAKNYIKSLTATILTMSSSRLPGLEGPGPKLYQHYQQQQQVAGGALGATEAQPQGHLQRYSTQIHSFREGT

SEQ ID NO: 14797 - protein, 235 aa, Homo Sapiens
MLRGAPGLGLTARKGAEDSAEDLGGPCPEPGGDSGVLGANGASCSRGEAEEPAGRRRARPVRSKARRMAANVRERKRILDYNEAFNALRRALRHDLGGKRLSKIATLRRAIHRIAALSLVLRASPAPRGPCGHLECHGPAARGDTGDTGASPPPPAGPSLARPDAARPSVPSAPRCASCPPHAPLARPSAVAEGPGLAQASGGSWRRCPGASSAGPPPWPRGYLRSAPGMGHPRS

SEQ ID NO: 14798 - protein, 547 aa, Homo Sapiens
MAGTKNKTRAQAKTEKKAAIQAKAGAEREATGVVRPVAKTRAKAKAKTGSKTDAVAEMKAVSKNKVVAETKEGALSEPKTLGKAMGDFTPKAGNESTSSTCKNEAGTDAWFWAGEEATINSWFWNGEEAGNSFSTKNDKPEIGAQVCAEELEPAAGADCKPRSGAEEEEEENVIGNWFWEGDDTSFDPNPKPVSRIVKPQPVYEINEKNRPKDWSEVTIWPNAPAVTPAVLGFRSQAPSEASPPSYIVLASAEENACSLPVATACRPSRNTRSCSQPIPECRFDSDPCIQTIDEIRRQIRIREVNGIKPFACPCKMECYMDSEEFEKLVSLLKSTTDPLIHKIARIAMGVHNVHPFAQEFINEVGVVTLIESLLSFPSPEMRKKTVITLNPPSGDERQRKIELHVKHMCKETMSFPLNSPGQQSGLKILGQLTTDFVHHYIVANYFSELFHLLSSGNCKTRNLVLKLLLNMSENPTAARDMINMKALAALKLIFNQKEAKANLVSGVAIFINIKEHIRKGSIVVVDHLSYNTLMAIFREVKEIIETM

SEQ ID NO: 14799 - protein, 381 aa, Homo Sapiens
MERGMHLGAAAAGEDDLFLHKSLSASTSKRLEAAFRSTPPGMDLSLAPPPRERPASSSSSPLGCFEPADPEGAGLLLPPPGGGGGGSAGSGGGGGGGVGVPGLLVGSAGVGGDPSLSSLPAGAALCLKYGESASRGSVAESSGGEQSPDDDSDGRCELVLRAGVADPRASPGAGGGGAKAAEGCSNAHLHGGASVPPGGLGGGGGGGSSSGSSGGGGGSGSGSGGSSSSSSSSSKKSKEQKALRLNINARERRRMHDLNDALDELRAVIPYAHSPSVRKLSKIATLLLAKNYILMQAQALEEMRRLVAYLNQGQAISAASLPSSAAAAAAAAALHPALGAYEQAAGYPFSAGLPPAASCPEKCALFNSVSSSLCKQCTEKP

SEQ ID NO: 14800 - protein, 225 aa, Homo Sapiens
MAELKSLSGDAYLALSHGYAAAAAGLAYGAAREPEAARGYGTPGPGGDLPAAPAPRAPAQAAESSGEQSGDEDDAFEQRRRRRGPGSAADGRRRPREQRSLRLSINARERRRMHDLNDALDGLRAVIPYAHSPSVRKLSKIATLLLAKNYILMQAQALDEMRRLVAFLNQGQGLAAPVNAAPLTPFGQATVCPFSAGAALGPCPDKCAAFSGTPSALCKHCHEKP

SEQ ID NO: 14801 - protein, 412 aa, Homo Sapiens
MERIPSAQPPPACLPKAPGLEHGDLPGMYPAHMYQVYKSRRGIKRSEDSKETYKLPHRLIEKKRRDRINECIAQLKDLLPEHLKLTTLGHLEKAVVLELTLKHVKALTNLIDQQQQKIIALQSGLQAGELSGRNVETGQEMFCSGFQTCAREVLQYLAKHENTRDLKSSQLVTHLHRVVSELLQGGTSRKPSDPAPKVMDFKEKPSSPAKGSEGPGKNCVPVIQRTFAHSSGEQSGSDTDTDSGYGGESEKGDLRSEQPCFKSDHGRRFTMGERIGAIKQESEEPPTKKNRMQLSDDEGHFTSSDLISSPFLGPHPHQPPFCLPFYLIPPSATAYLPMLEKCWYPTSVPVLYPGLNASAAALSSFMNPDKISAPLLMPQRLPSPLPAHPSVDSSVLLQALKPIPPLNLETKD

SEQ ID NO: 14802 - protein, 482 aa, Homo Sapiens
MDEGIPHLQERQLLEHRDFIGLDYSSLYMCKPKRSMKRDDTKDTYKLPHRLIEKKRRDRINECIAQLKDLLPEHLKLTTLGHLEKAVVLELTLKHLKALTALTEQQHQKIIALQNGERSLKSPIQSDLDAFHSGFQTCAKEVLQYLSRFESWTPREPRCVQLINHLHAVATQFLPTPQLLTQQVPLSKGTGAPSAAGSAAAPCLERAGQKLEPLAYCVPVIQRTQPSAELAAENDTDTDSGYGGEAEARPDREKGKGAGASRVTIKQEPPGEDSPAPKRMKLDSRGGGSGGGPGGGAAAAAAALLGPDPAAAAALLRPDAALLSSLVAFGGGGGAPFPQPAAAAAPFCLPFCFLSPSAAAAYVQPFLDKSGLEKYLYPAAAAAPFPLLYPGIPAPAAAAAAAAAAAAAAAAFPCLSSVLSPPPEKAGAAAATLLPHEVAPLGAPHPQHPHGRTHLPFAGPREPGNPESSAQEDPSQPGKEAP

SEQ ID NO: 14803 - protein, 825 aa, Homo Sapiens
MLDICLEKRVGTTLAAPKCNSSTVRFQGLAEGTKGTMKMDMEDADMTLWTEAEFEEKCTYIVNDHPWDSGADGGTSVQAEASLPRNLLFKYATNSEEVIGVMSKEYIPKGTRFGPLIGEIYTNDTVPKNANRKYFWRIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPHPMLNPTSLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 14804 - protein, 396 aa, Homo Sapiens; identical to SEQ ID NO: 1492

SEQ ID NO: 14805 - protein, 994 aa, Homo Sapiens; identical to SEQ ID NO: 1514

SEQ ID NO: 14806 - protein, 1099 aa, Homo Sapiens
MAHLGPTPPPHSLNYKSEDRLSEQDWPAYFKVPCCGVDTSQIESEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRHSANINLHRKLLTKELDDMGLDSSQPSLSKDLRDEFLVKIYGAQHPMGLDVREDASSPAGTEDSHLNGYGRGMAEDYMVLDLSTTSSLQSSSSIHSSRESDAGSDEGILLDDIDGASDSGESAHKAEAPALPGSLGAEVSGSLMFSSLSGSNGGIMCNICHKMYSNKGTLRVHYKTVHLREMHKCKVPGCNMMFSSVRSRNRHSQNPNLHKNIPFTSVD

SEQ ID NO: 14807 - protein, 137 aa, Homo Sapiens; identical to SEQ ID NO: 1531

SEQ ID NO: 14808 - protein, 86 aa, Homo Sapiens
MELSAEYLREKLQRDLEAEHVEVEDTTLNRCSCSFRVLVVSAKFEGKPLLQRHRLVNACLAEELPHIHAFEQKTLTPDQWARERQK

SEQ ID NO: 14809 - protein, 107 aa, Homo Sapiens
MAAWSPAAAAPLLRGIRGLPLHHRMFATQTEGELRVTQILKEKFPRATAIKVTDISGGCGAMYEIKIESEEFKEKRTVQQHQMVNQALKEEIKEMHGLRIFTSVPKR

SEQ ID NO: 14810 - protein, 3046 aa, Homo Sapiens
MRGRRGRPPKQPAAPAAERCAPAPPPPPPPPTSGPIGGLRSRHRGSSRGRWAAAQAEVAPKTRLSSPRGGSSSRRKPPPPPPAPPSTSAPGRGGRGGGGGRTGGGGGGGHLARTTAARRAVNKVVYDDHESEEEEEEEDMVSEEEEEEDGDAEETQDSEDDEEDEMEEDDDDSDYPEEMEDDDDDASYCTESSFRSHSTYSSTPGRRKPRVHRPRSPILEEKDIPPLEFPKSSEDLMVPNEHIMNVIAIYEVLRNFGTVLRLSPFRFEDFCAALVSQEQCTLMAEMHVVLLKAVLREEDTSNTTFGPADLKDSVNSTLYFIDGMTWPEVLRVYCESDKEYHHVLPYQEAEDYPYGPVENKIKVLQFLVDQFLTTNIAREELMSEGVIQYDDHCRVCHKLGDLLCCETCSAVYHLECVKPPLEEVPEDEWQCEVCVAHKVPGVTDCVAEIQKNKPYIRHEPIGYDRSRRKYWFLNRRLIIEEDTENENEKKIWYYSTKVQLAELIDCLDKDYWEAELCKILEEMREEIHRHMDITEDLTNKARGSNKSFLAAANEEILESIRAKKGDIDNVKSPEETEKDKNETENDSKDAEKNREEFEDQSLEKDSDDKTPDDDPEQGKSEEPTEVGDKGNSVSANLGDNTTNATSEETSPSEGRSPVGCLSETPDSSNMAEKKVASELPQDVPEEPNKTCESSNTSATTTSIQPNLENSNSSSELNSSQSESAKAADDPENGERESHTPVSIQEEIVGDFKSEKSNGELSESPGAGKGASGSTRIITRLRNPDSKLSQLKSQQVAAAAHEANKLFKEGKEVLVVNSQGEISRLSTKKEVIMKGNINNYFKLGQEGKYRVYHNQYSTNSFALNKHQHREDHDKRRHLAHKFCLTPAGEFKWNGSVHGSKVLTISTLRLTITQLENNIPSSFLHPNWASHRANWIKAVQMCSKPREFALALAILECAVKPVVMLPIWRESLGHTRLHRMTSIEREEKEKVKKKEKKQEEEETMQQATWVKYTFPVKHQVWKQKGEEYRVTGYGGWSWISKTHVYRFVPKLPGNTNVNYRKSLEGTKNNMDENMDESDKRKCSRSPKKIKIEPDSEKDEVKGSDAAKGADQNEMDISKITEKKDQDVKELLDSDSDKPCKEEPMEVDDDMKTESHVNCQESSQVDVVNVSEGFHLRTSYKKKTKSSKLDGLLERRIKQFTLEEKQRLEKIKLEGGIKGIGKTSTNSSKNLSESPVITKAKEGCQSDSMRQEQSPNANNDQPEDLIQGCSESDSSVLRMSDPSHTTNKLYPKDRVLDDVSIRSPETKCPKQNSIENDIEEKVSDLASRGQEPSKSKTKGNDFFIDDSKLASADDIGTLICKNKKPLIQEESDTIVSSSKSALHSSVPKSTNDRDATPLSRAMDFEGKLGCDSESNSTLENSSDTVSIQDSSEEDMIVQNSNESISEQFRTREQDVEVLEPLKCELVSGESTGNCEDRLPVKGTEANGKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTTTGGTLVTSMTVSKEYSTRDKVKLMKFSRPKKTRSGTALPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTETSETEITTTEIIKRRDVGPYGIRSEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQPQVQSSTQTLSSGQTLNQVTVSSPSRPQLQIQQPQPQVIAVPQLQQQVQVLSQIQSQVVAQIQAQQSGVPQQIKLQLPIQIQQSSAVQTHQIQNVVTVQAASVQEQLQRVQQLRDQQQKKKQQQIEIKREHTLQASNQSEIIQKQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPAPPAPPAPPPSPPPPPAVQHTGLLSTPTLPAASQKRKREEEKDSSSKSKKKKMISTTSKETKKDTKLYCICKTPYDESKFYIGCDRCQNWYHGRCVGILQSEAELIDEYVCPQCQSTEDAMTVLTPLTEKDYEGLKRVLRSLQAHKMAWPFLEPVDPNDAPDYYGVIKEPMDLATMEERVQRRYYEKLTEFVADMTKIFDNCRYYNPSDSPFYQCAEVLESFFVQKLKGFKASRSHNNKLQSTAS

SEQ ID NO: 14811 - protein, 1863 aa, Homo Sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 14812 - protein, 233 aa, Homo Sapiens
MNLNFTSPLHPASSQRPTSFFIEDILLHKPKPLREVAPDHFASSLASRVPLLDYGYPLMPTPTLLAPHAHHPLHKGDHHHPYFLTTSGMPVPALFPHPQHAELPGKHCRRRKARTVFSDSQLSGLEKRFEIQRYLSTPERVELATALSLSETQVKTWFQNRRMKHKKQLRKSQDEPKAPDGPESPEGSPRGSEAATAAEARLSLPAGPFVLTEPEDEVDIGDEGELGSGPHVL

SEQ ID NO: 14813 - protein, 1177 aa, Homo Sapiens
MDVYPPRRQGLPRARSPGGSSRGSPSVSCSRLRQVQSILTQSSKSRPDGILCILGIDSRYNEGCRELANYLLFGLYNQNTSDFEKTGFSEEVLDDVIILIKSDSVHLYCNPVNFRYLLPYVAHWRNLHFHCMTENEYEDEEAAEEFKITSFVDMVRDCSRIGIPYSSQGHLQIFDMFVVEKWPIVQAFALEGIGGDGFFTMKYELQDVSLNLWNVYSKMDPMSLESLLSDDLVAFEHQWTSFFANFDTEIPFLLELSESQAGEPFRSYFSHGMISSHITENSPNRQPFVLFGNHSTRENLNAGNFNFPSEGHLVRSTGPGGSFAKHMVAQCVSPKGPLACSRTYFFGATHVPYLGGDSKLPKKTEQIRLLSQIYAAVIEAVLAGIACYAKTSSLTKAKEVAEQTLGSGLDSFELIPFKAALRSKMTFHIHAVNNQGRIVPLDSEDSLSFVKTACMAVYDIPDLLGGNGCLGSVVFSESFLTSQILVKEKDGTVTTETSSVVLTAAVPRFCSWLVEDNEVKLSEKTQQAVRGDESFLGTYLTGGEGAYLYSSNLQSWPEEGNVHFFSSGLLFSHCRHRSIIISKDHMNSISFYDGDSTSTVAALLIDFKSSLLPHLPVHFHGSSNFLMIALFPKSKIYQAFYSEVFSLWKQQDNSGISLKVIQEDGLSVEQKRLHSSAQKLFSALSQPAGEKRSSLKLLSAKLPELDWFLQHFAISSISQEPVMRTHLPVLLQQAEINTTHRIESDKVIISIVTGLPGCHASELCAFLVTLHKECGRWMVYRQIMDSSECFHAAHFQRYLSSALEAQQNRSARQSAYIRKKTRLLVVLQGYTDVIDVVQALQTHPDSNVKASFTIGAITACVEPMSCYMEHRFLFPKCLDQCSQGLVSNVVFTSHTTEQRHPLLVQLQSLIRAANPAAAFILAENGIVTRNEDIELILSENSFSSPEMLRSRYLMYPGWYEGKLNAGSVYPLMVQICVWFGRPLEKTRFVAKCKAIQSSIKPSPFSGNIYHILGKVKFSDSERTMEVCYNTLANSLSIMPVLEGPTPPPDSKSVSQDSSGQQECYLVFIGCSLKEDSIKDWLRQSAKQKPQRKALKTRGMLTQQEIRSIHVKRHLEPLPAGYFYNGTQFVNFFGDKTDFHPLMDQFMNDYVEEANREIEKYNQELEQQEYHDLFELKP

SEQ ID NO: 14814 - protein, 1673 aa, Homo Sapiens
MWRAEGKWLPKTSRKSVSQSVFCGTSTYCVLNTVPPIEDDHGNSNSSHVKIFLPKKLLECLPKCSSLPKERHRWNTNEEIAAYLITFEKHEEWLTTSPKTRPQNGSMILYNRKKVKYRKDGYCWKKRKDGKTTREDHMKLKVQGVECLYGCYVHSSIIPTFHRRCYWLLQNPDIVLVHYLNVPAIEDCGKPCGPILCSINTDKKEWAKWTKEELIGQLKPMFHGIKWTCSNGNSSSGFSVEQLVQQILDSHQTKPQPRTHNCLCTGSLGAGGSVHHKCNSAKHRIISPKVEPRTGGYGSHSEVQHNDVSEGKHEHSHSKGSSREKRNGKVAKPVLLHQSSTEVSSTNQVEVPDTTQSSPVSISSGLNSDPDMVDSPVVTGVSGMAVASVMGSLSQSATVFMSEVTNEAVYTMSPTAGPNHHLLSPDASQGLVLAVSSDGHKFAFPTTGSSESLSMLPTNVSEELVLSTTLDGGRKIPETTMNFDPDCFLNNPKQGQTYGGGGLKAEMVSSNIRHSPPGERSFSFTTVLTKEIKTEDTSFEQQMAKEAYSSSAAAVAASSLTLTAGSSLLPSGGGLSPSTTLEQMDFSAIDSNKDYTSSFSQTGHSPHIHQTPSPSFFLQDASKPLPVEQNTHSSLSDSGGTFVMPTVKTEASSQTSSCSGHVETRIESTSSLHLMQFQANFQAMTAEGEVTMETSQAAEGSEVLLKSGELQACSSEHYLQPETNGVIRSAGGVPILPGNVVQGLYPVAQPSLGNASNMELSLDHFDISFSNQFSDLINDFISVEGGSSTIYGHQLVSGDSTALSQSEDGARAPFTQAEMCLPCCSPQQGSLQLSSSEGGASTMAYMHVAEVVSAASAQGTLGMLQQSGRVFMVTDYSPEWSYPEGGVKVLITGPWQEASNNYSCLFDQISVPASLIQPGVLRCYCPAHDTGLVTLQVAFNNQIISNSVVFEYKARALPTLPSSQHDWLSLDDNQFRMSILERLEQMERRMAEMTGSQQHKQASGGGSSGGGSGSGNGGSQAQCASGTGALGSCFESRVVVVCEKMMSRACWAKSKHLIHSKTFRGMTLLHLAAAQGYATLIQTLIKWRTKHADSIDLELEVDPLNVDHFSCTPLMWACALGHLEAAVVLYKWDRRAISIPDSLGRLPLGIARSRGHVKLAECLEHLQRDEQAQLGQNPRIHCPASEEPSTESWMAQWHSEAISSPEIPKGVTVIASTNPELRRPRSEPSNYYSSESHKDYPAPKKHKLNPEYFQTRQEKLLPTALSLEEPNIRKQSPSSKQSVPETLSPSEGVRDFSRELSPPTPETAAFQASGSQPVGKWNSKDLYIGVSTVQVTGNPKGTSVGKEAAPSQVRPREPMSVLMMANREVVNTELGSYRDSAENEECGQPMDDIQVNMMTLAEHIIEATPDRIKQENFVPMESSGLERTDPATISSTMSWLASYLADADCLPSAAQIRSAYNEPLTPSSNTSLSPVGSPVSEIAFEKPNLPSAADWSEFLSASTSEKVENEFAQLTLSDHEQRELYEAARLVQTAFRKYKGRPLREQQEVAAAVIQRCYRKYKQYALYKKMTQAAILIQSKFRSYYEQKKFQQSRRAAVLIQKYYRSYKKCGKRRQARRTAVIVQQKLRSSLLTKKQDQAARKIMRFLRRCRHSPLVDHRLYKRSERIEKGQGT

SEQ ID NO: 14815 - protein, 1202 aa, Homo Sapiens
MNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMECLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHAHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQLTWIALKFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 14816 - protein, 147 aa, Homo Sapiens
MSSEPPPPPQPPTHQASVGLLDTPRSRERSPSPLRGNVVPSPLPTRRTRTFSATVRASQGPVYKGVCKCFCRSKGHGFITPADGGPDIFLHISDVEGEYVPVEGDEVTYKMCSIPPKNEKLQAVEVVITHLAPGTKHETWSGHVISS

SEQ ID NO: 14817 - protein, 1759 aa, Homo Sapiens
MDLGTAEGTRCTDPPAGKPAMAPKRKGGLKLNAICAKLSRQVVVEKRADAGSHTEGSPSQPRDQERSGPESGAARAPRSEEDKRRAVIEKWVNGEYSEEPAPTPVLGRIAREGLELPPEGVYMVQPQGCSDEEDHAEEPSKDGGALEEKDSDGAASKEDSGPSTRQASGEASSLRDYAASTMTEFLGMFGYDDQNTRDELARKISFEKLHAGSTPEAATSSMLPTSEDTLSKRARFSKYEEYIRKLKAGEQLSWPAPSTKTEERVGKEVVGTLPGLRLPSSTAHLETKATILPLPSHSSVQMQNLVARASKYDFFIQKLKTGENLRPQNGSTYKKPSKYDLENVKYLHLFKPGEGSPDMGGAIAFKTGKVGRPSKYDVRGIQKPGPAKVPPTPSLAPAPLASVPSAPSAPGPGPEPPASLSFNTPEYLKSTFSKTDSITTGTVSTVKNGLPTDKPAVTEDVNIYQKYIARFSGSQHCGHIHCAYQYREHYHCLDPECNYQRFTSKQDVIRHYNMHKKRDNSLQHGFMRFSPLDDCSVYYHGCHLNGKSTHYHCMQVGCNKVYTSTSDVMTHENFHKKNTQLINDGFQRFRATEDCGTADCQFYGQKTTHFHCRRPGCTFTFKNKCDIEKHKSYHIKDDAYAKDGFKKFYKYEECKYEGCVYSKATNHFHCIRAGCGFTFTSTSQMTSHKRKHERRHIRSSGALGLPPSLLGAKDTEHEESSNDDLVDFSALSSKNSSLSASPTSQQSSASLAAATAATEAGPSATKPPNSKISGLLPQGLPGSIPLALALSNSGLPTPTPYFPILAGRGSTSLPVGTPSLLGAVSSGSAASATPDTPTLVASGAGDSAPVAAASVPAPPASIMERISASKGLISPMMARLAAAALKPSATFDPGSGQQVTPARFPPAQVKPEPGESTGAPGPHEASQDRSLDLTVKEPSNESNGHAVPANSSLLSSLMNKMSQGNPGLGSLLNIKAEAEGSPAAEPSPFLGKAVKALVQEKLAEPWKVYLRRFGTKDFCDGQCDFLHKAHFHCVVEECGALFSTLDGAIKHANFHFRTEGGAAKGNTEAAFPASAAETKPPMAPSSPPVPPVTTATVSSLEGPAPSPASVPSTPTLLAWKQLASTIPQMPQIPASVPHLPASPLATTSLENAKPQVKPGFLQFQENDPCLATDCKYANKFHFHCLFGNCKYVCKTSGKAESHCLDHINPNNNLVNVRDQFAYYSLQCLCPNQHCEFRMRGHYHCLRTGCYFVTNITTKLPWHIKKHEKAERRAANGFKYFTKREECGRLGCKYNQVNSHFHCIREGCQFSFLLKHQMTSHARKHMRRMLGKNFDRVPPSQGPPGLMDAETDECMDYTGCSPGAMSSESSTMDRSCSSTPVGNESTAAGNTISMPTASGAKKRFWIIEDMSPFGKRRKTASSRKMLDEGMMLEGFRRFDLYEDCKDAACQFSLKVTHYHCTRENCGYKFCGRTHMYKHAQHHDRVDNLVLDDFKRFKASLSCHFADCPFSGTSTHFHCLRCRFRCTDSTKVTAHRKHHGKQDVISAAGFCQFSSSADCAVPDCKYKLKCSHFHCTFPGCRHTVVGMSQMDSHKRKHEKQERGEPAAEGPAPGPPISLDGSLSLGAEPGSLLFLQSAAAGLGLALGDAGDPGPPDAAAPGPREGAAAAAAAAGESSQEDEEEELELPEEEAEDDEDEDDDEDDDDEDDDEDDDDEDLRTDSEESLPEAAAEAAGAGARTPALAALAALGAPGPAPTAASSP

SEQ ID NO: 14818 - protein, 182 aa, Homo Sapiens
MPRVVPDQRSKFENEEFFRKLSRECEIKYTGFRDRPHEERQARFQNACRDGRSEIAFVATGTNLSLQFFPASWQGEQRQTPSREYVDLEREAGKVYLKAPMILNGVCVIWKGWIDLQRLDGMGCLEFDEERAQQEDALAQQAFEEARRRTREFEDRDRSHREEMEVRVSQLLAVTGKKTTRP

SEQ ID NO: 14819 - protein, 727 aa, Homo Sapiens
MESEDTKKTQEMKTDLNLLLECLKYQMDNAFSQKEALVTIHSICQQNSNASVYFREIGGLMFVKNLAKSSEHSMVKEAALYTLGAIAEKNVYCQQTLCTSELFEDLTWFLSNDSNINLKRMSVYVILVLVSNNRTGQTLVRETGCITVLSRLFRTVISKHELDLSDKNVFQSYQLWSSVCSTLCVCVNNPQNDENQMFCCSLFPHANEWLKNCTTPEIIRPICSFIGLTLANNTYVQKYFVSVGGLDVLSQVLMQLESDSHETLSSAKLAVVVTKTVDACIADNPTFGIVLSKYHIVSKLLALLLHESLDSGEKFSIMLTLGHCTEDCEENQYDLFKNNGLPLMIQALTESQNEELNKAATFVLHNCKKITEKLSLSLGEYPFDENETQQLKDISVKENNLEEHWRKAKEILHRIEQLEREGNEEEIQRENYQDNISSMNISIQNTWKHLHADRIGRGSKAEDEDKSHSRQLQSYKSHGVMSKACTNDDQMKTPLKSANPVHACYRESEQNKTLYKAKSSCNQNLHEETTFEKNFVSQSSDHVFKHPVHIAKNIKQQLPVTDPFTLCSDIINKEVVSFLATPSCSEMLTYRCSGCIAVEKSLNSRNFSKLLHSCPYQCDRHKVIVEAEDRYKSELRKSLICNKKILLTPRRRQRLSNESTTPGGIKKRRIRKNFTEEEVNYLFNGVKKMGNHWNSILWSFPFQQGRKAVDLAHKYHKLTKHPTCAAS

SEQ ID NO: 14820 - protein, 802 aa, Homo Sapiens
MPRIMIKGGVWRNTEDEILKAAVMKYGKNQWSRIASLLHRKSAKQCKARWYEWLDPSIKKTEWSREEEEKLLHLAKLMPTQWRTIAPIIGRTAAQCLEHYEFLLDKAAQRDNEEETTDDPRKLKPGEIDPNPETKPARPDPIDMDEDELEMLSEARARLANTQGKKAKRKAREKQLEEARRLAALQKRRELRAAGIEIQKKRKRKRGVDYNAEIPFEKKPALGFYDTSEENYQALDADFRKLRQQDLDGELRSEKEGRDRKKDKQHLKRKKESDLPSAILQTSGVSEFTKKRSKLVLPAPQISDAELQEVVKVGQASEIARQTAEESGITNSASSTLLSEYNVTNNSVALRTPRTPASQDRILQEAQNLMALTNVDTPLKGGLNTPLHESDFSGVTPQRQVVQTPNTVLSTPFRTPSNGAEGLTPRSGTTPKPVINSTPGRTPLRDKLNINPEDGMADYSDPSYVKQMERESREHLRLGLLGLPAPKNDFEIVLPENAEKELEEREIDDTYIEDAADVDARKQAIRDAERVKEMKRMHKAVQKDLPRPSEVNETILRPLNVEPPLTDLQKSEELIKKEMITMLHYDLLHHPYEPSGNKKGKTVGFGTNNSEHITYLEHNPYEKFSKEELKKAQDVLVQEMEVVKQGMSHGELSSEAYNQVWEECYSQVLYLPGQSRYTRANLASKKDRIESLEKRLEINRGHMTTEAKRAAKMEKKMKILLGGYQSRAMGLMKQLNDLWDQIEQAHLELRTFEELKKHEDSAIPRRLECLKEDVQRQQEREKELQHRYADLLLEKETLKSKF

SEQ ID NO: 14821 - protein, 265 aa, Homo Sapiens
MYVGYVLDKDSPVYPGPARPASLGLGPQAYGPPAPPPAPPQYPDFSSYSHVEPAPAPPTAWGAPFPAPKDDWAAAYGPGPAAPAASPASLAFGPPPDFSPVPAPPGPGPGLLAQPLGGPGTPSSPGAQRPTPYEWMRRSVAAGGGGGSGKTRTKDKYRVVYTDHQRLELEKEFHYSRYITIRRKSELAANLGLTERQVKIWFQNRRAKERKVNKKKQQQQQPPQPPMAHDITATPAGPSLGGLCPSNTSLLATSSPMPVKEEFLP

SEQ ID NO: 14822 - protein, 313 aa, Homo Sapiens
MYVSYLLDKDVSMYPSSVRHSGGLNLAPQNFVSPPQYPDYGGYHVAAAAAAAANLDSAQSPGPSWPAAYGAPLREDWNGYAPGGAAAAANAVAHGLNGGSPAAAMGYSSPADYHPHHHPHHHPHHPAAAPSCASGLLQTLNPGPPGPAATAAAEQLSPGGQRRNLCEWMRKPAQQSLGSQVKTRTKDKYRVVYTDHQRLELEKEFHYSRYITIRRKAELAATLGLSERQVKIWFQNRRAKERKINKKKLQQQQQQQPPQPPPPPPQPPQPQPGPLRSVPEPLSPVSSLQASVPGSVPGVLGPTGGVLNPTVTQ

SEQ ID NO: 14823 - protein, 284 aa, Homo Sapiens
MYGSCLLEKEAGMYPGTLMSPGGDGTAGTGGTGGGGSPMPASNFAAAPAFSHYMGYPHMPSMDPHWPSLGVWGSPYSPPREDWSVYPGPSSTMGTVPVNDVTSSPAAFCSTDYSNLGPVGGGTSGSSLPGQAGGSLVPTDAGAAKASSPSRSRHSPYAWMRKTVQVTGKTRTKEKYRVVYTDHQRLELEKEFHCNRYITIQRKSELAVNLGLSERQVKIWFQNRRAKERKMIKKKISQFENSGGSVQSDSDSISPGELPNTFFTTPSAVRGFQPIEIQQVIVSE

SEQ ID NO: 14824 - protein, 358 aa, Homo Sapiens
MESADFYEAEPRPPMSSHLQSPPHAPSSAAFGFPRGAGPAQPPAPPAAPEPLGGICEHETSIDISAYIDPAAFNDEFLADLFQHSRQQEKAKAAVGPTGGGGGGDFDYPGAPAGPGGAVMPGGAHGPPPGYGCAAAGYLDGRLEPLYERVGAPALRPLVIKQEPREEDEAKQLALAGLFPYQPPPPPPPSHPHPHPPPAHLAAPHLQFQIAHCGQTTMHLQPGHPTPPPTPVPSPHPAPALGAAGLPGPGSALKGLGAAHPDLRASGGSGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 14825 - protein, 345 aa, Homo Sapiens
MQRLVAWDPACLPLPPPPPAFKSMEVANFYYEADCLAAAYGGKAAPAAPPAARPGPRPPAGELGSIGDHERAIDFSPYLEPLGAPQAPAPATATDTFEAAPPAPAPAPASSGQHHDFLSDLFSDDYGGKNCKKPAEYGYVSLGRLGAAKGALHPGCFAPLHPPPPPPPPPAELKAEPGFEPADCKRKEEAGAPGGGAGMAAGFPYALRAYLGYQAVPSGSSGSLSTSSSSSPPGTPSPADAKAPPTACYAGAAPAPSQVKSKAKKTVDKHSDEYKIRRERNNIAVRKSRDKAKMRNLETQHKVLELTAENERLQKKVEQLSRELSTLRNLFKQLPEPLLASSGHC

SEQ ID NO: 14826 - protein, 269 aa, Homo Sapiens
MSAALFSLDGPARGAPWPAEPAPFYEPGRAGKPGRGAEPGALGEPGAAAPAMYDDESAIDFSAYIDSMAAVPTLELCHDELFADLFNSNHKAGGAGPLELLPGGPARPLGPGPAAPRLLKREPDWGDGDAPGSLLPAQVAACAQTVVSLAAAGQPTPPTSPEPPRSSPRQTPAPGPAREKSAGKRGPDRGSPEYRQRRERNNIAVRKSRDKAKRRNQEMQQKLVELSAENEKLHQRVEQLTRDLAGLRQFFKQLPSPPFLPAAGTADCR

SEQ ID NO: 14827 - protein, 281 aa, Homo Sapiens
MSHGTYYECEPRGGQQPLEFSGGRAGPGELGDMCEHEASIDLSAYIESGEEQLLSDLFAVKPAPEARGLKGPGTPAFPHYLPPDPRPFAYPPHTFGPDRKALGPGIYSSPGSYDPRAVAVKEEPRGPEGSRAASRGSYNPLQYQVAHCGQTAMHLPPTLAAPGQPLRVLKAPLATAAPPCSPLLKAPSPAGPLHKGKKAVNKDSLEYRLRRERNNIAVRKSRDKAKRRILETQQKVLEYMAENERLRSRVEQLTQELDTLRNLFRQIPEAANLIKGVGGCS

SEQ ID NO: 14828 - protein, 150 aa, Homo Sapiens
MSKISQQNSTPGVNGISVIHTQAHASGLQQVPQLVPAGPGGGGKAVAPSKQSKKSSPMDRNSDEYRQRRERNNMAVKKSRLKSKQKAQDTLQRVNQLKEENERLEAKIKLLTKELSVLKDLFLEHAHNLADNVQSISTENTTADGDNAGQ

SEQ ID NO: 14829 - protein, 1054 aa, Homo Sapiens
MAAVKEPLEFHAKRPWRPEEAVEDPDEEDEDNTSEAENGFSLEEVLRLGGTKQDYLMLATLDENEEVIDGGKKGAIDDLQQGELEAFIQNLNLAKYTKASLVEEDEPAEKENSSKKEVKIPKINNKNTAESQRTSVNKVKNKNRPEPHSDENGSTTPKVKKDKQNIFEFFERQTLLLRPGGKWYDLEYSNEYSLKPQPQDVVSKYKTLAQKLYQHEINLFKSKTNSQKGASSTWMKAIVSSGTLGDRMAAMILLIQDDAVHTLQFVETLVNLVKKKGSKQQCLMALDTFKELLITDLLPDNRKLRIFSQRPFDKLEQLSSGNKDSRDRRLILWYFEHQLKHLVAEFVQVLETLSHDTLVTTKTRALTVAHELLCNKPEEEKALLVQVVNKLGDPQNRIATKASHLLETLLCKHPNMKGVVSGEVERLLFRSNISSKAQYYAICFLNQMALSHEESELANKLITVYFCFFRTCVKKKDVESKMLSALLTGVNRAYPYSQTGDDKVREQIDTLFKVLHIVNFNTSVQALMLLFQVMNSQQTISDRYYTALYRKMLDPGLMTCSKQAMFLNLVYKSLKADIVLRRVKAFVKRLLQVTCQQMPPFICGALYLVSEILKAKPGLRSQLDDHPESDDEENFIDANDDEDMEKFTDADKETEIVKKLETEETVPETDVETKKPEVASWVHFDNLKGGKQLNKYDPFSRNPLFCGAENTSLWELKKLSVHFHPSVALFAKTILQGNYIQYSGDPLQDFTLMRFLDRFVYRNPKPHKGKENTDSVVMQPKRKHFIKDIRHLPVNSKEFLAKEESQIPVDEVFFHRYYKKVAVKEKQKRDADEESIEDVDDEEFEELIDTFEDDNCFSSGKDDMDFAGNVKKRTKGAKDNTLDEDSEGSDDELGNLDDDEVSLGSMDDEEFAEVDEDGGTFMDVLDDESESVPELEVHSKVSTKKSKRKGTDDFDFAGSFQGPRKKKRNLNDSSLFVSAEEFGHLLDENMGSKFDNIGMNAMANKDNASLKQLRWEAERDDWLHNRDAKSIIKKKKHFKKKRIKTTQKTKKQRK

SEQ ID NO: 14830 - protein, 561 aa, Homo Sapiens
MADHNPDSDSTPRTLLRRVLDTADPRTPRRPRSARAGARRALLETASPRKLSGQTRTIARGRSHGARSVGRSAHIQASGHLEEQTPRTLLKNILLTAPESSILMPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNSPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLSSEPAEPLLVRHPPRPRTTGPRPRQDPHKAGLSHYVKLFSFYAKMPMERKALEMVEKCLDKYFQHLCDDLEVFAAHAGRKTVKPEDLELLMRRQGLVTDQVSLHVLVERHLPLEYRQLLIPCAYSGNSVFPAQ

SEQ ID NO: 14831 - protein, 383 aa, Homo Sapiens
MFWTFKEWFWLERFWLPPTIKWSDLEDHDGLVFVKPSHLYVTIPYAFLLLIIRRVFEKFVASPLAKSFGIKETVRKVTPNTVLENFFKHSTRQPLQTDIYGLAKKCNLTERQVERWFRSRRNQERPSRLKKFQEACWRFAFYLMITVAGIAFLYDKPWLYDLWEVWNGYPKQPLLPSQYWYYILEMSFYWSLLFRLGFDVKRKDFLAHIIHHLAAISLMSFSWCANYIRSGTLVMIVHDVADIWLESAKMFSYAGWTQTCNTLFFIFSTIFFISRLIVFPFWILYCTLILPMYHLEPFFSYIFLNLQLMILQVLHLYWGYYILKMLNRCIFMKSIQDVRSDDEDYEEEEEEEEEEATKGKEMDCLKNGLRAERHLIPNGQHGH

SEQ ID NO: 14832 - protein, 384 aa, Homo Sapiens
MAGILAWFWNERFWLPHNVTWADLKNTEEATFPQAEDLYLAFPLAFCIFMVRLIFERFVAKPCAIALNIQANGPQIAPPNAILEKVFTAITKHPDEKRLEGLSKQLDWDVRSIQRWFRQRRNQEKPSTLTRFCESMWRFSFYLYVFTYGVRFLKKTPWLWNTRHCWYNYPYQPLTTDLHYYYILELSFYWSLMFSQFTDIKRKDFGIMFLHHLVSIFLITFSYVNNMARVGTLVLCLHDSADALLEAAKMANYAKFQKMCDLLFVMFAVVFITTRLGIFPLWVLNTTLFESWEIVGPYPSWWVFNLLLLLVQGLNCFWSYLIVKIACKAVSRGKVSKDDRSDIESSSDEEDSEPPGKNPHTATTTNGTSGTNGYLLTGSCSMDD

SEQ ID NO: 14833 - protein, 812 aa, Homo Sapiens
MEAFQELRKPSARLECDHCSFRGTDYENVQIHMGTIHPEFCDEMDAGGLGKMIFYQKSAKLFHCHKCFFTSKMYSNVYYHITSKHASPDKWNDKPKNQLNKETDPVKSPPLPEHQKIPCNSAEPKSIPALSMETQKLGSVLSPESPKPTPLTPLEPQKPGSVVSPELQTPLPSPEPSKPASVSSPEPPKSVPVCESQKLAPVPSPEPQKPAPVSPESVKATLSNPKPQKQSHFPETLGPPSASSPESPVLAASPEPWGPSPAASPESRKSARTTSPEPRKPSPSESPEPWKPFPAVSPEPRRPAPAVSPGSWKPGPPGSPRPWKSNPSASSGPWKPAKPAPSVSPGPWKPIPSVSPGPWKPTPSVSSASWKSSSVSPSSWKSPPASPESWKSGPPELRKTAPTLSPEHWKAVPPVSPELRKPGPPLSPEIRSPAGSPELRKPSGSPDLWKLSPDQRKTSPASLDFPESQKSSRGGSPDLWKSSFFIEPQKPVFPETRKPGPSGPSESPKAASDIWKPVLSIDTEPRKPALFPEPAKTAPPASPEARKRALFPEPRKHALFPELPKSALFSESQKAVELGDELQIDAIDDQKCDILVQEELLASPKKLLEDTLFPSSKKLKKDNQESSDAELSSSEYIKTDLDAMDIKGQESSSDQEQVDVESIDFSKENKMDMTSPEQSRNVLQFTEEKEAFISEEEIAKYMKRGKGKYYCKICCCRAMKKGAVLHHLVNKHNVHSPYKCTICGKAFLLESLLKNHVAAHGQSLLKCPRCNFESNFPRGFKKHLTHCQSRHNEEANKKLMEALEPPLEEQQI

SEQ ID NO: 14834 - protein, 1608 aa, Homo Sapiens
MYSAHRPLMPASSAASRGLGMFVWTNVEPRSVAVFPWHSLVPFLAPSQPDPSVQPSEAQQPASHPVASNQSKEPAESAAVAHERPPGGTGSADPERPPGATCPESPGPGPPHPLGVVESGKGPPPTTEEEASGPPGEPRLDSETESDHDDAFLSIMSPEIQLPLPPGKRRTQSLSALPKERDSSSEKDGRSPNKREKDHIRRPMNAFMIFSKRHRALVHQRHPNQDNRTVSKILGEWWYALGPKEKQKYHDLAFQVKEAHFKAHPDWKWCNKDRKKSSSEAKPTSLGLAGGHKETRERSMSETGTAAAPGVSSELLSVAAQTLLSSDTKAPGSSSCGAERLHTVGGPGSARPRAFSHSGVHSLDGGEVDSQALQELTQMVSGPASYSGPKPSTQYGAPGPFAAPGEGGALAATGRPPLLPTRASRSQRAASEDMTSDEERMVICEEEGDDDVIADDGFGTTDIDLKCKERVTDSESGDSSGEDPEGNKGFGRKVFSPVIRSSFTHCRPPLDPEPPGPPDPPVAFGKGYGSAPSSSASSPASSSASAATSFSLGSGTFKAQESGQGSTAGPLRPPPPGAGGPATPSKATRFLPMDPATFRRKRPESVGGLEPPGPSVIAAPPSGGGNILQTLVLPPNKEEQEGGGARVPSAPAPSLAYGAPAAPLSRPAATMVTNVVRPVSSTPVPIASKPFPTSGRAEASPNDTAGARTEMGTGSRVPGGSPLGVSLVYSDKKSAAATSPAPHLVAGPLLGTVGKAPATVTNLLVGTPGYGAPAPPAVQFIAQGAPGGGTTAGSGAGAGSGPNGPVPLGILQPGALGKAGGITQVQYILPTLPQQLQVAPAPAPAPGTKAAAPSGPAPTTSIRFTLPPGTSTNGKVLAATAPTPGIPILQSVPSAPPPKAQSVSPVQAPPPGGSAQLLPGKVLVPLAAPSMSVRGGGAGQPLPLVSPPFSVPVQNGAQPPSKIIQLTPVPVSTPSGLVPPLSPATLPGPTSQPQKVLLPSSTRITYVQSAGGHALPLGTSPASSQAGTVTSYGPTSSVALGFTSLGPSGPAFVQPLLSAGQAPLLAPGQVGVSPVPSPQLPPACAAPGGPVITAFYSGSPAPTSSAPLAQPSQAPPSLVYTVATSTTPPAATILPKGPPAPATATPAPTSPFPSATAGSMTYSLVAPKAQRPSPKAPQKVKAAIASIPVGSFEAGASGRPGPAPRQPLEPGPVREPTAPESELEGQPTPPAPPPLPETWTPTARSSPPLPPPAEERTSAKGPETMASKFPSSSSDWRVPGQGLENRGEPPTPPSPAPAPAVAPGGSSESSSGRAAGDTPERKEAAGTGKKVKVRPPPLKKTFDSVDNRVLSEVDFEERFAELPEFRPEEVLPSPTLQSLATSPRAILGSYRKKRKNSTDLDSAPEDPTSPKRKMRRRSSCSSEPNTPKSAKCEGDIFTFDRTGTEAEDVLGELEYDKVPYSSLRRTLDQRRALVMQLFQDHGFFPSAQATAAFQARYADIFPSKVCLQLKIREVRQKIMQAATPTEQPPGAEAPLPVPPPTGTAAAPAPTPSPAGGPDPTSPSSDSGTAQAAPPLPPPPESGPGQPGWEGAPQPSPPPPGPSTAATGR

SEQ ID NO: 14835 - protein, 898 aa, Homo Sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 14836 - protein, 846 aa, Homo Sapiens
MLFTVSCSKMSSIVDRDDSSIFDGLVEEDDKDKAKRVSRNKSEKKRRDQFNVLIKELGSMLPGNARKMDKSTVLQKSIDFLRKHKEITAQSDASEIRQDWKPTFLSNEEFTQLMLEALDGFFLAIMTDGSIIYVSESVTSLLEHLPSDLVDQSIFNFIPEGEHSEVYKILSTHLLESDSLTPEYLKSKNQLEFCCHMLRGTIDPKEPSTYEYVKFIGNFKSLNSVSSSAHNGFEGTIQRTHRPSYEDRVCFVATVRLATPQFIKEMCTVEEPNEEFTSRHSLEWKFLFLDHRAPPIIGYLPFEVLGTSGYDYYHVDDLENLAKCHEHLMQYGKGKSCYYRFLTKGQQWIWLQTHYYITYHQWNSRPEFIVCTHTVVSYAEVRAERRRELGIEESLPETAADKSQDSGSDNRINTVSLKEALERFDHSPTPSASSRSSRKSSHTAVSDPSSTPTKIPTDTSTPPRQHLPAHEKMVQRRSSFSSQSINSQSVGSSLTQPVMSQATNLPIPQGMSQFQFSAQLGAMQHLKDQLEQRTRMIEANIHRQQEELRKIQEQLQMVHGQGLQMFLQQSNPGLNFGSVQLSSGNSSNIQQLAPINMQGQVVPTNQIQSGMNTGHIGTTQHMIQQQTLQSTSTQSQQNVLSGHSQQTSLPSQTQSTLTAPLYNTMVISQPAAGSMVQIPSSMPQNSTQSAAVTTFTQDRQIRFSQGQQLVTKLVTAPVACGAVMVPSTMLMGQVVTAYPTFATQQQQSQTLSVTQQQQQQSSQEQQLTSVQQPSQAQLTQPPQQFLQTSRLLHGNPSTQLILSAAFPLQQSTFPQSHHQQHQSQQQQQLSRHRTDSLPDPSKVQPQ

SEQ ID NO: 14837 - protein, 575 aa, Homo Sapiens
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQRYDTPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVAGEEEVKVSTMPLSTSSHSLQQGQQPTSLHTTVA

SEQ ID NO: 14838 - protein, 301 aa, Homo Sapiens
MSYPTKEGSDTAGNAHKNSENEPPNDCSTDIESPSADPNMIYQVETNPINREPGTATSQEDVVPQAAENSELETEIQKDQREEDLKEELLLLQTPIPRKLVSHKPLNDRSRSHSGKVEMKANNFPINHKTRFRLSTSWRVPFINSHEIRSMILHLLCDRYFSQAAGCQNTMWVKRKYIACLYHPNSFTHHERAITFRRPSRVHYYRPLTERMTSGKFCKSTDTKGKCRFRAIVRSVLFVSQIQIESIFNIKGFVDILTYIHTMNVMITNTNNGWKYFCPICGRLFNTYSELRQHSCSSSGN

SEQ ID NO: 14839 - protein, 1269 aa, Homo Sapiens
MTVKLGDGGSGEDGLKKLGKRAADEESLEGEGAGGADAAEESSGTKRDEKTPRAGADGPPAPPGAPQAPSPPQGSPQDQHHFLRSSVRPQSKRPRKDPPSAVGSGNAGGSGPRGKGAEGGGSSSGNVSGVAPAAPAGGSRSSSRNLGSSGGEKEEGKKVRRQWESWSTEDKNTFFEGLYEHGKDFEAIQNNIALKYKKKGKPASMVKNKEQVRHFYYRTWHKITKYIDFDHVFSRGLKKSSQELYGLICYGELRKKIGGCMDDKNATKLNELIQVGATTVRYKGRNLRIKAPMCRALKKLCDPDGLSDEEDQKPVRLPLKVPIELQPRNNHAWARVQSLAQNPRLRMIVELHRKVSSLIEFLKQKWALHEVRVRKTLEERQLQDSCSAPMQEKVTLHLFPGENCTLTPLPGVARVVHSKAFCTVHWQEGGRCKQSAKDAHVLPPAQILGIQSGQGTARGQVKCPRSGAEGKGVGRPPPAADALQSSGESSPESAPGEGAALSLSSPDAPDRPPPRHQDTGPCLEKTPAEGRDSPTREPGALPCACGQLPDLEDELSLLDPLPRYLKSCQDLIVPEQCRCADTRPGSEQPPLGGAASPEVLAPVSKEAADLAPTGPSPRPGPGLLLDVCTKDLADAPAEELQEKGSPAGPPPSQGQPAARPPKEVPASRLAQQLREEGWNLQTSESLTLAEVYLMMGKPSKLQLEYDWLGPGRQDPRPGSLPTALHKQRLLSCLLKLISTEVNPKLALEANTISTASVRPAQEEQSMTPPGKVVTVSSRSPRCPRNQASLRSSKTFPPSSAPCSSGLRNPPRPLLVPGPSSTGSNDSDGGLFAVPTTLPPNSRHGKLFSPSKEAELTFRQHLNSISMQSDFFLPKPRKLRNRHLRKPLVVQRTLLPRPSENQSHNVCSFSILSNSSVTGRGSFRPIQSSLTKAALSRPIVPKVLPPQATSHLASAIDLAATSAGILSGNPLPALDTEGLSGISPLSSDEVTGAISGQDSTGTHQDGDTLPTVGGSDPFVSIPSRPEQEPVADSFQGSSVLSLSELPKAPLQNGLSIPLSSSESSSTRLSPPDVSALLDISLPGPPEDALSQGEPATHISDSIIEIAISSGQYGEGVPLSPAKLNGSDSSKSLPSPSSSPQPHWIASPTHDPQWYPSDSTDSSLSSLFASFISPEKSRKMLPTPIGTNSGTSLLGPSLLDGNSRDSFVSRSLADVAEVVDSQLVCMMNENSIDYISRFNDLAQELSIAEPGRREALFDGGGGGPAVSDLSQ

SEQ ID NO: 14840 - protein, 341 aa, Homo Sapiens
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNREAARECRRKKKEYVKCLENRVAVLENQNKTLIEELKALKDLYCHKSD

SEQ ID NO: 14841 - protein, 371 aa, Homo Sapiens
MELELDAGDQDLLAFLLEESGDLGTAPDEAVRAPLDWALPLSEVPSDWEVDDLLCSLLSPPASLNILSSSNPCLVHHDHTYSLPRETVSMDLESESCRKEGTQMTPQHMEELAEQEIARLVLTDEEKSLLEKEGLILPETLPLTKTEEQILKRVRRKIRNKRSAQESRRKKKVYVGGLESRVLKYTAQNMELQNKVQLLEEQNLSLLDQLRKLQAMVIEISNKTSSSSTCILVLLVSFCLLLVPAMYSSDTRGSLPAEHGVLSRQLRALPSEDPYQLELPALQSEVPKDSTHQWLDGSDCVLQAPGNTSCLLHYMPQAPSAEPPLEWPFPDLFSEPLCRGPILPLQANLTRKGGWLPTGSPSVILQDRYSG

SEQ ID NO: 14842 - protein, 519 aa, Homo Sapiens
MDAVLEPFPADRLFPGSSFLDLGDLNESDFLNNAHFPEHLDHFTENMEDFSNDLFSSFFDDPVLDEKSPLLDMELDSPTPGIQAEHSYSLSGDSAPQSPLVPIKMEDTTQDAEHGAWALGHKLCSIMVKQEQSPELPVDPLAAPSAMAAAAAMATTPLLGLSPLSRLPIPHQAPGEMTQLPVIKAEPLEVNQFLKVTPEDLVQMPPTPPSSHGSDSDGSQSPRSLPPSSPVRPMARSSTAISTSPLLTAPHKLQGTSGPLLLTEEEKRTLIAEGYPIPTKLPLTKAEEKALKRVRRKIKNKISAQESRRKKKEYVECLEKKVETFTSENNELWKKVETLENANRTLLQQLQKLQTLVTNKISRPYKMAATQTGTCLMVAALCFVLVLGSLVPCLPEFSSGSQTVKEDPLAADGVYTASQMPSRSLLFYDDGAGLWEDGRSTLLPMEPPDGWEINPGGPAEQRPRDHLQHDHLDSTHETTKYLSEAWPKDGGNGTSPDFSHSKEWFHDRDLGPNTTIKLS

SEQ ID NO: 14843 - protein, 520 aa, Homo Sapiens
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDEVESEKWYLSTDFPSTSIKTEPVTDEPPPGLVPSVTLTITAISTPLEKEEPPLEMNTGVDSSCQTIIPKIKLEPHEVDQFLNFSPKEAPVDHLHLPPTPPSSHGSDSEGSLSPNPRLHPFSLPQTHSPSRAAPRAPSALSSSPLLTAPHKLQGSGPLVLTEEEKRTLIAEGYPIPTKLPLSKSEEKALKKIRRKIKNKISAQESRRKKKEYMDSLEKKVESCSTENLELRKKVEVLENTNRTLLQQLQKLQTLVMGKVSRTCKLAGTQTGTCLMVVVLCFAVAFGSFFQGYGPYPSATKMALPSQHSLQEPYTASVVRSRNLLIYEEHSPPEESSSPGSAGELGGWDRGSSLLRVSGLESRPDVDLPHFIISNETSLEKSVLLELQQHLVSAKLEGNETLKVVELDRRVNTTF

SEQ ID NO: 14844 - protein, 461 aa, Homo Sapiens
MNTDLAAGKMASAACSMDPIDSFELLDLLFDRQDGILRHVELGEGWGHVKDQQVLPNPDSDDFLSSILGSGDSLPSSPLWSPEGSDSGISEDLPSDPQDTPPRSGPATSPAGCHPAQPGKGPCLSYHPGNSCSTTTPGPVIQVPEASVTIDLEMWSPGGRICAEKPADPVDLSPRCNLTVKDLLLSGSSGDLQQHHLGASYLLRPGAGHCQELVLTEDEKKLLAKEGITLPTQLPLTKYEERVLKKIRRKIRNKQSAQESRKKKKEYIDGLETRMSACTAQNQELQRKVLHLEKQNLSLLEQLKKLQAIVVQSTSKSAQTGTCVAVLLLSFALIILPSISPFGPNKTESPGDFAPVRVFSRTLHNDAASRVAADAVPGSEAPGPRPEADTTREESPGSPGADWGFQDTANLTNSTEELDNATLVLRNATEGLGQVALLDWVAPGPSTGSGRAGLEAAGDEL

SEQ ID NO: 14845 - protein, 395 aa, Homo Sapiens
MDLGIPDLLDAWLEPPEDIFSTGSVLELGLHCPPPEVPVTRLQEQGLQGWKSGGDRGCGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLLPCQTLFLTDEEKRLLGQEGVSLPSHLPLTKAEERVLKKVRRKIRNKQSAQDSRRRKKEYIDGLESRVAACSAQNQELQKKVQELERHNISLVAQLRQLQTLIAQTSNKAAQTSTCVLILLFSLALIILPSFSPFQSRPEAGSEDYQPHGVTSRNILTHKDVTENLETQVVESRLREPPGAKDANGSTRTLLEKMGGKPRPSGRIRSVLHADEM

SEQ ID NO: 14846 - protein, 508 aa, Homo Sapiens
MIYEESKMNLEQERPFVCSAPGCSQRFPTEDHLMIHRHKHEMTLKFPSIKTDNMLSDQTPTPTRFLKNCEEVGLFSELDCSLEHEFRKAQEEESSKRNISMHNAVGGAMTGPGTHQLSSARLPNHDTNVVIQQAMPSPQSSSVITQAPSTNRQIGPVPGSLSSLLHLHNRQRQPMPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERNRAAATRCRQKRKVWVMSLEKKAEELTQTNMQLQNEVSMLKNEVAQLKQLLLTHKDCPITAMQKESQGYLSPESSPPASPVPACSQQQVIQHNTITTSSSVSEVVGSSTLSQLTTHRTDLNPIL

SEQ ID NO: 14847 - protein, 2442 aa, Homo Sapiens
MAENLLDGPPNPKRAKLSSPGFSANDSTDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 14848 - protein, 120 aa, Homo Sapiens
MDDSKVVGGKVKKPGKRGRKPAKIDLKAKLERSRQSARECRARKKLRYQYLEELVSSRERAICALREELEMYKQWCMAMDQGKIPSEIKALLTGEEQNKSQQNSSRHTKAGKTDANSNSW

SEQ ID NO: 14849 - protein, 639 aa, Homo Sapiens
MPQPSVSGMDPPFGDAFRSHTFSEQTLMSTDLLANSSDPDFMYELDREMNYQQNPRDNFLSLEDCKDIENLESFTDVLDNEGALTSNWEQWDTYCEDLTKYTKLTSCDIWGTKEVDYLGLDDFSSPYQDEEVISKTPTLAQLNSEDSQSVSDSLYYPDSLFSVKQNPLPSSFPGKKITSRAAAPVCSSKTLQAEVPLSDCVQKASKPTSSTQIMVKTNMYHNEKVNFHVECKDYVKKAKVKINPVQQSRPLLSQIHTDAAKENTCYCGAVAKRQEKKGMEPLQGHATPALPFKETQELLLSPLPQEGPGSLAAGESSSLSASTSVSDSSQKKEEHNYSLFVSDNLGEQPTKCSPEEDEEDEEDVDDEDHDEGFGSEHELSENEEEEEEEEDYEDDKDDDISDTFSEPGYENDSVEDLKEVTSISSRKRGKRRYFWEYSEQLTPSQQERMLRPSEWNRDTLPSNMYQKNGLHHGKYAVKKSRRTDVEDLTPNPKKLLQIGNELRKLNKVISDLTPVSELPLTARPRSRKEKNKLASRACRLKKKAQYEANKVKLWGLNTEYDNLLFVINSIKQEIVNRVQNPRDERGPNMGQKLEILIKDTLGLPVAGQTSEFVNQVLEKTAEGNPTGGLVGLRIPTSKV

SEQ ID NO: 14850 - protein, 354 aa, Homo Sapiens
MRHSLTKLLAASGSNSPTRSESPEPAATCSLPSDLTRAAAGEEETAAAGSPGRKQQFGDEGELEAGRGSRGGVAVRAPSPEEMEEEAIASLPGEETEDMDFLSGLELADLLDPRQPDWHLDPGLSSPGPLSSSGGGSDSGGLWRGDDDDEAAAAEMQRFSDLLQRLLNGIGGCSSSSDSGSAEKRRRKSPGGGGGGGSGNDNNQAATKSPRKAAAAAARLNRLKKKEYVMGLESRVRGLAAENQELRAENRELGKRVQALQEESRYLRAVLANETGLARLLSRLSGVGLRLTTSLFRDSPAGDHDYALPVGKQKQDLLEEDDSAGGVCLHVDKDKVSVEFCSACARKASSSLKM

SEQ ID NO: 14851 - protein, 361 aa, Homo Sapiens
MSKCARKKYIKTNPRQMTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 14852 - protein, 299 aa, Homo Sapiens [sequence omitted]

SEQ ID NO: 14853 - protein, 589 aa, Homo Sapiens
MTGLLKRKFDQLDEDNSSVSSSSSSSGCQSRSCSPSSSVSRAWDSEEEGPWDQMPLPDRDFCGPRSFTPLSILKRARRERPGRVAFDGITVFYFPRCQGFTSVPSRGGCTLGMALRHSACRRFSLAEFAQEQARARHEKLRQRLKEEKLEMLQWKLSAAGVPQAEAGLPPVVDAIDDASVEEDLAVAVAGGRLEEVSFLQPYPARRRRALLRASGVRRIDREEKRELQALRQSREDCGCHCDRICDPETCSCSLAGIKCQMDHTAFPCGCCREGCENPMGRVEFNQARVQTHFIHTLTRLQLEQEAESFRELEAPAQGSPPSPGEEALVPTFPLAKPPMNNELGDNSCSSDMTDSSTASSSASGTSEAPDCPTHPGLPGPGFQPGVDDDSLARILSFSDSDFGGEEEEEEEGSVGNLDNLSCFHPADIFGTSDPGGLASWTHSYSGCSFTSGVLDENANLDASCFLNGGLEGSREGSLPGTSVPPSMDAGRSSSVDLSLSSCDSFELLQALPDYSLGPHYTSQKVSDSLDNIEAPHFPLPGLSPPGDASSCFLESLMGFSEPAAEALDPFIDSQFEDTVPASLMEPVPV

SEQ ID NO: 14854 - protein, 543 aa, Homo Sapiens
MDAFTGSGLKRKFDDVDVGSSVSNSDDEISSSDSADSCDSLNPPTTASFTPTSILKRQKQLRRKNVRFDQVTVYYFARRQGFTSVPSQGGSSLGMAQRHNSVRSYTLCEFAQEQEVNHREILREHLKEEKLHAKKMKLTKNGTVESVEADGLTLDDVSDEDIDVENVEVDDYFFLQPLPTKRRRALLRASGVHRIDAEEKQELRAIRLSREECGCDCRLYCDPEACACSQAGIKCQVDRMSFPCGCSRDGCGNMAGRIEFNPIRVRTHYLHTIMKLELESKRQVSRPAAPDEEPSPTASCSLTGAQGSETQDFQEFIAENETAVMHLQSAEELERLKAEEDSSGSSASLDSSIESLGVCILEEPLAVPEELCPGLTAPILIQAQLPPGSSVLCFTENSDHPTASTVNSPSYLNSGPLVYYQVEQRPVLGVKGEPGTEEGSASFPKEKDLNVFSLPVTSLVACSSTDPAALCKSEVGKTPTLEALLPEDCNPEEPENEDFHPSWSPSSLPFRTDNEEGCGMVKTSQQNEDRPPEDSSLELPLAV

SEQ ID NO: 14855 - protein, 585 aa, Homo Sapiens
MSGILKRKFEEVDGSSPCSSVRESDDEVSSSESADSGDSVNPSTSSHFTPSSILKREKRLRTKNVHFSCVTVYYFTRRQGFTSVPSQGGSTLGMSSRHNSVRQYTLGEFAREQERLHREMLREHLREEKLNSLKLKMTKNGTVESEEASTLTLDDISDDDIDLDNTEVDEYFFLQPLPTKKRRALLRASGVKKIDVEEKHELRAIRLSREDCGCDCRVFCDPDTCTCSLAGIKCQVDRMSFPCGCTKEGCSNTAGRIEFNPIRVRTHFLHTIMKLELEKNREQQIPTLNGCHSEISAHSSSMGPVAHSVEYSIADSFEIETEPQAAVLHLQSAEELDCQGEEEEEEEDGSSFCSGVTDSSTQSLAPSESDEEEEEEEEEEEEEDDDDDKGDGFVEGLGTHAEVVPLPSVLCYSDGTAVHESHAKNASFYANSSTLYYQIDSHIPGTPNQISENYSERDTVKNGTLSLVPYTMTPEQFVDYARQAEEAYGASHYPAANPSVIVCCSSSENDSGVPCNSLYPEHRSNHPQVEFHSYLKGPSQEGFVSALNGDSHISEHPAENSLSLAEKSILHEECIKSPVVETVPV

SEQ ID NO: 14856 - protein, 727 aa, Homo Sapiens
MEGDAVEAIVEESETFIKGKERKTYQRRREGGQEEDACHLPQNQTDGGEVVQDVNSSVQMVMMEQLDPTLLQMKTEVMEGTVAPEAEAAVDDTQIITLQVVNMEEQPINIGELQLVQVPVPVTVPVATTSVEELQGAYENEVSKEGLAESEPMICHTLPLPEGFQVVKVGANGEVETLEQGELPPQEDPSWQKDPDYQPPAKKTKKTKKSKLRYTEEGKDVDVSVYDFEEEQQEGLLSEVNAEKVVGNMKPPKPTKIKKKGVKKTFQCELCSYTCPRRSNLDRHMKSHTDERPHKCHLCGRAFRTVTLLRNHLNTHTGTRPHKCPDCDMAFVTSGELVRHRRYKHTHEKPFKCSMCDYASVEVSKLKRHIRSHTGERPFQCSLCSYASRDTYKLKRHMRTHSGEKPYECYICHARFTQSGTMKMHILQKHTENVAKFHCPHCDTVIARKSDLGVHLRKQHSYIEQGKKCRYCDAVFHERYALIQHQKSHKNEKRFKCDQCDYACRQERHMIMHKRTHTGEKPYACSHCDKTFRQKQLLDMHFKRYHDPNFVPAAFVCSKCGKTFTRRNTMARHADNCAGPDGVEGENGGETKKSKRGRKRKMRSKKEDSSDSENAEPDLDDNEDEEEPAVEIEPEPEPQPVTPAPPPAKKRRGRPPGRTNQPKQNQPTAIIQVEDQNTGAIENIIVEVKKEPDAEPAEGEEEEAQPAATDAPNGDLTPEMILSMMDR

SEQ ID NO: 14857 - protein, 663 aa, Homo Sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDEAAAEEASTTKGEQFPGEMFPVACRETTARVKEEVDEGVTCEMLLNTMDK

SEQ ID NO: 14858 - protein, 1505 aa, Homo Sapiens
MLCVAGARLKRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGSARRKGKDQPESRRPGSLPAPPPSQLPRNPGEQASNTNGTHQFSPAGLSQDFFSSSLASPSLPLASTGKFALNSLLQRQLMQSFYSKAMQEAGSTSMIFSTGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRENPGQSLNRLFQEVPKRRNGSEGNITTRIRASETGSDEAIKSILEQAKRELQVQKTAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 14859 - protein, 678 aa, Homo Sapiens
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 14860 - protein, 1486 aa, Homo Sapiens
MAANVGSMFQYWKRFDLRRLQKELNSVASELSARQEESEHSHKHLIELRREFKKNVPEEIREMVAPVLKSFQAEVVALSKRSQEAEAAFLSVYKQLIEAPDPVPVFEAARSLDDRLQPPSFDPSGQPRRDLHTSWKRNPELLSPKEQREGTSPAGPTLTEGSRLPGIPGKALLTETLLQRNEAEKQKGLQEVQITLAARLGEAEEKIKVLHSALKATQAELLELRRKYDEEAASKADEVGLIMTNLEKANQRAEAAQREVESLREQLASVNSSIRLACCSPQGPSGDKVNFTLCSGPRLEAALASKDREILRLLKDVQHLQSSLQELEEASANQIADLERQLTAKSEAIEKLEEKLQAQSDYEEIKTELSILKAMKLASSTCSLPQGMAKPEDSLLIAKEAFFPTQKFLLEKPSLLASPEEDPSEDDSIKDSLGTEQSYPSPQQLPPPPGPEDPLSPSPGQPLLGPSLGPDGTRTFSLSPFPSLASGERLMMPPAAFKGEAGGLLVFPPAFYGAKPPTAPATPAPGPEPLGGPEPADGGGGGAAGPGAEEEQLDTAEIAFQVKEQLLKHNIGQRVFGHYVLGLSQGSVSEILARPKPWRKLTVKGKEPFIKMKQFLSDEQNVLALRTIQVRQRGSITPRIRTPETGSDDAIKSILEQAKKEIESQKGGEPKTSVAPLSIANGTTPASTSEDAIKSILEQARREMQAQQQALLEMEVAPRGRSVPPSPPERPSLATASQNGAPALVKQEEGSGGPAQAPLPVLSPAAFVQSIIRKVKSEIGDAGYFDHHWASDRGLLSRPYASVSPSLSSSSSSGYSGQPNGRAWPRGDEAPVPPEDEAAAGAEDEPPRTGELKAEGATAEAGARLPYYPAYVPRTLKPTVPPLTPEQYELYMYREVDTLELTRQVKEKLAKNGICQRIFGEKVLGLSQGSVSDMLSRPKPWSKLTQKGREPFIRMQLWLSDQLGQAVGQQPGASQASPTEPRSSPSPPPSPTEPEKSSQEPLSLSLESSKENQQPEGRSSSSLSGKMYSGSQAPGGIQEIVAMSPELDTYSITKRVKEVLTDNNLGQRLFGESILGLTQGSVSDLLSRPKPWHKLSLKGREPFVRMQLWLNDPHNVEKLRDMKKLEKKAYLKRRYGLISTGSDSESPATRSECPSPCLQPQDLSLLQIKKPRVVLAPEEKEALRKAYQLEPYPSQQTIELLSFQLNLKTNTVINWFHNYRSRMRREMLVEGTQDEPDLDPSGGPGILPPGHSHPDPTPQSPDSETEDQKPTVKELELQEGPEENSTPLTTQDKAQVRIKQEQMEEDAEEEAGSQPQDSGELDKGQGPPKEEHPDPPGNDGLPKVAPGPLLPGGSTPDCPSLHPQQESEAGERLHPDPLSFKSASESSRCSLEVSLNSPSAASSPGLMMSVSPVPSSSAPISPSPPGAPPAKVPSASPTADMAGALHPSAKVNPNLQRRHEKMANLNNIIYRVERAANREEALEWEF

SEQ ID NO: 14861 - protein, 656 aa, Homo Sapiens
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGATRLFCDVYNPQSKTYCKRLQVLCPEHSRDPKVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 14862 - protein, 760 aa, Homo Sapiens
MAVPAALIPPTQLVPPQPPISTSASSSGTTTSTSSATSSPAPSIGPPASSGPTLFRPEPIASAAAAAATVTSTGGGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVGSSDGSWDKETLPSSPSQGPQASITHPRMPGARSLPLSHPLNHLQQSHLLPNGLELPFMMMPHPLIPVSLPPASVTMAMSQMNHLSTIANMAAAAQVQSPPSRVETSVIKERVPDSPSPAPSLEEGRRPGSHPSSHRSSSVSSSPARTESSSDRIPVHQNGLSMNQMLMGLSPNVLPGPKEGDLAGHDMGHESKRMHIEKDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 14863 - protein, 599 aa, Homo Sapiens
MAVSASPVISATSSGAGVPGGLFRAEPLYSTPREPPRLTPNMINSFVVNNHSNSAGGGGRGNTNTNECRMVDMHGMKVASFLMDGQELICLPQVFDLFLKHLVGGLHTVYTKLKRLDISPVVCTVEQVRILRGLGAIQPGVNRCKLITRKDFETLFTDCTNARRKRQMTRKQAVNSSRPGRPPKRSLGVLQENARLLTHAVPGLLSPGLITPTGITAAAMAEAMKLQKMKLMAMNTLQGNGSQNGTESEPDDLNSNTGGSESSWDKDKMQSPFAAPGPQHGIAHAALAGQPGIGGAPTLNPLQQNHLLTNRLDLPFMMMPHPLLPVSLPPASVAMAMNQMNHLNTIANMAAAAQIHSPLSRAGTSVIKERIPESPSPAPSLEENHRPGSQTSSHTSSSVSSSPSQMDHHLERMEEVPVQIPIMKSPLDKIQLTPGQALPAGFPGPFIFADSLSSVETLLTNIQGLLKVALDNARIQEKQIQQEKKELRLELYREREIRENLERQLAVELQSRTTMQKRLKKEKKTKRKLQEALEFESKRREQVEQALKQATTSDSGLRMLKDTGIPDIEIENNGTPHDSAAMQGGNYYCLEMAQQLYSA

SEQ ID NO: 14864 - protein, 325 aa, Homo Sapiens
MARPVSDRTPAPLLLGGPAGTPPGGGALLGLRSLLQGTSKPKEPASCLLKEKERKAALPAATTPGPGLETAGPADAPAGAVVGGGSPRGRPGPVPAPGLLAPLLWERTLPFGDVEYVDLDAFLLEHGLPPSPPPPGGPSPEPSPARTPAPSPGPGSCGSASPRSSPGHAPARAALGTASGHRAGLTSRDTPSPVDPDTVEVLMTFEPDPADLALSSIPGHETFDPRRHRFSEEELKPQPIMKKARKIQVPEEQKDEKYWSRRYKNNEAAKRSRDARRLKENQISVRAAFLEKENALLRQEVVAVRQELSHYRAVLSRYQAQHGAL

SEQ ID NO: 14865 - protein, 343 aa, Homo Sapiens
MMFPGLLAPPAGYPSLLRPTPTLTLPQSLQSAFSGHSSFLVEDLIRISRPPAYLPRSVPTASMSPPRQGAPTALTDTGASDLGSPGPGSRRGGSPPTAFSPASETTFLKFGVNAILSSGPRTETSPALLQSVPPKTFAFPYFEGSFQPFIRSSYFPASSSVVPIPGTFSWPLAARGKPRRGMLRRAVFSDVQRKALEKMFQKQKYISKPDRKKLAAKLGLKDSQVKIWFQNRRMKWRNSKERELLSSGGCREQTLPTKLNPHPDLSDVGQKGPGNEEEEEGPGSPSHRLAYHASSDPQHLRDPRLPGPLPPSPAHSSSPGKPSDFSDSEEEEEGEEQEEITVS

SEQ ID NO: 14866 - protein, 339 aa, Homo Sapiens
MLPSAVAAHAGAYWDVVASSALLNLPAAPGFGNLGKSFLIENLLRVGGAPTPRLQPPAPHDPATALATAGAQLRPLPASPVPLKLCPAAEQVSPAGAPYGTRWAFQVLSPSADSARLPGRAPGDRDCTFQPSAPAPSKPFLLSTPPFYSACCGGSCRRPASSTAFPREESMLPLLTQDSNSKARRGILRRAVFSEDQRKALEKMFQKQKYISKTDRKKLAINLGLKESQVKIWFQNRRMKWRNSKEKEVLSNRCIQEVGLQEDPLSRSALGFPSPCPSIWDVPQQHSSPRWRENSPEPSERLIQESSGAPPPEANSLQGALYLCSEEEAGSKGVLTGAV

SEQ ID NO: 14867 - protein, 427 aa, Homo Sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVILLNMDGKELWNLRMHKKKVTHVALNPCCDWFLATASVDQTVKIWDLRQVRGKASFLYSLPHRHPVNAACFSPDGARLLTTDQKSEIRVYSASQWDCPLGLIPHPHRHFQHLTPIKAAWHPRYNLIVVGRYPDPNFKSCTPYELRTIDVFDGNSGKMMCQLYDPESSGISSLNEFNPMGDTLASAMGYHILIWSQEEARTRK

SEQ ID NO: 14868 - protein, 169 aa, Homo Sapiens
MAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 14869 - protein, 565 aa, Homo Sapiens; identical to SEQ ID NO: 4097

SEQ ID NO: 14870 - protein, 255 aa, Homo Sapiens
MTMTTMPESLNSPVSGKAVFMEFGPPNQQMSPSPMSHGHYSMHCLHSAGHSQPDGAYSSASSFSRPLGYPYVNSVSSHASSPYISSVQSYPGSASLAQSRLEDPGADSEKSTVVEGGEVRFNGKGKKIRKPRTIYSSLQLQALNRRFQQTQYLALPERAELAASLGLTQTQVKIWFQNKRSKFKKLMKQGGAALEGSALANGRALSAGSPPVPPGWNPNSSSGKGSGGNAGSYIPSYTSWYPSAHQEAMQQPQLM

SEQ ID NO: 14871 - protein, 328 aa, Homo Sapiens
MTGVFDSLVADMHSTQIAASSTYHQHQQPPSGGGAGPGGNSSSSSSLHKPQESPTLPVSTATDSSYYTNQQHPAGGGGGGGSPYAHMGSYQYQASGLNNVPYSAKSSYDLGYTAAYTSYAPYGTSSSPANNEPEKEDLEPEIRIVNGKPKKVRKPRTIYSSFQLAALQRRFQKTQYLALPERAELAASLGLTQTQVKIWFQNRRSKFKKMWKSGEIPSEQHPGASASPPCASPPVSAPASWDFGVPQRMAGGGGPGSGGSGAGSSGSSPSSAASAFLGNYPWYHQTSGSASHLQATAPLLHPTQTPQPHHHHHHHGGGGAPVSAGTIF

SEQ ID NO: 14872 - protein, 287 aa, Homo Sapiens
MSGSFDRKLSSILTDISSSLSCHAGSKDSPTLPESSVTDLGYYSAPQHDYYSGQPYGQTVNPYTYHHQFNLNGLAGTGAYSPKSEYTYGASYRQYGAYREQPLPAQDPVSVKEEPEAEVRMVNGKPKKVRKPRTIYSSYQLAALQRRFQKAQYLALPERAELAAQLGLTQTQVKIWFQNRRSKFKKLYKNGEVPLEHSPNNSDSMACNSPPSPALWDTSSHSTPAPARSQLPPPLPYSASPSYLDDPTNSWYHAQNLSGPHLQQQPPQPATLHHASPGPPPNPGAVY

SEQ ID NO: 14873 - protein, 240 aa, Homo Sapiens
MTSLPCPLPGRDASKAVFPDLAPVPSVAAAYPLGLSPTTAASPNLSYSRPYGHLLSYPYTEPANPGDSYLSCQQPAALSQPLCGPAEHPQELEADSEKPRLSPEPSERRPQAPAKKLRKPRTIYSSLQLQHLNQRFQHTQYLALPERAQLAAQLGLTQTQVKIWFQNKRSKYKKLLKQNSGGQEGDFPGRTFSVSPCSPPLPSLWDLPKAGTLPTSGYGNSFGAWYQHHSSDVLASPQMM

SEQ ID NO: 14874 - protein, 289 aa, Homo Sapiens
MTGVFDRRVPSIRSGDFQAPFQTSAAMHHPSQESPTLPESSATDSDYYSPTGGAPHGYCSPTSASYGKALNPYQYQYHGVNGSAGSYPAKAYADYSYASSYHQYGGAYNRVPSATNQPEKEVTEPEVRMVNGKPKKVRKPRTIYSSFQLAALQRRFQKTQYLALPERAELAASLGLTQTQVKIWFQNKRSKIKKIMKNGEMPPEHSPSSSDPMACNSPQSPAVWEPQGSSRSLSHHPHAHPPTSNQSPASSYLENSASWYTSAASSINSHLPPPGSLQHPLALASGTLY

SEQ ID NO: 14875 - protein, 175 aa, Homo Sapiens
MSHSQHSPYLQSYHNSSAAAQTRGDDTDQQKTTVIENGEIRFNGKGKKIRKPRTIYSSLQLQALNHRFQQTQYLALPERAELAASLGLTQTQVKIWFQNKRSKFKKLLKQGSNPHESDPLQGSAALSPRSPALPPVWDVSASAKGVSMPPNSYMPGYSHWYSSPHQDTMQRPQMM

SEQ ID NO: 14876 - protein, 467 aa, Homo Sapiens
MATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSRKRRESASSSSSVKKAKKP

SEQ ID NO: 14877 - protein, 382 aa, Homo Sapiens
MQHYGVNGYSLHAMNSLSAMYNLHQQAAQQAQHAPDYRPSVHALTLAERLAGCTFQDIILEARYGSQHRKQRRSRTAFTAQQLEALEKTFQKTHYPDVVMRERLAMCTNLPEARVQVWFKNRRAKFRKKQRSLQKEQLQKQKEAEGSHGEGKAEAPTPDTQLDTEQPPRLPGSDPPAELHLSLSEQSASESAPEDQPDREEDPRAGAEDPKAEKSPGADSKGLGCKRGSPKADSPGSLTITPVAPGGGLLGPSHSYSSSPLSLFRLQEQFRQHMAATNNLVHYSSFEVGGPAPAAAAAAAAVPYLGVNMAPLGSLHCQSYYQSLSAAAAAHQGVWGSPLLPAPPAGLAPASATLNSKTTSIENLRLRAKQHAASLGLDTLPN

SEQ ID NO: 14878 - protein, 373 aa, Homo Sapiens
MPNDEAFSKPSTPSEAPHAPGVPPQGRAGGFGKASGALVGAASGSSAGGSSRGGGSGSGASDLGAGSKKSPRLPKCARCRNHGYASPLKGHKRFCMWRDCQCKKCNLIAERQRVMAAQVALRRQQAQEEELGISHPIPLPSAAELLVKRENNGSNPCLMTECSGTSQPPPASVPTTAASEGRMVIQDIPAVTSRGHVENTPDLVSDSTYYSSFYQPSLFPYYNNLYNCPQYSMALAADSASGEVGNPLGGSPVKNSLRGLPGPYVPGQTGNQWQMKNMENRHAMSSQYRMHSYYPPPSYLGQSVPQFFTFEDAPSYPEARASVFSPPSSQDSGLVSLSSSSPISNKSTKAVLECEPASEPSSFTVTPVIEEDE

SEQ ID NO: 14879 - protein, 561 aa, Homo Sapiens
MADPQAGSAAGDWEIDVESLELEEDVCGAPRSTPPGPSPPPADGDCEDDEDDDGVDEDAEEEGDGEEAGASPGMPGQPEQRGGPQPRPPLAPQASPAGTGPRERCTPAGGGAEPRKLSRTPKCARCRNHGVVSCLKGHKRFCRWRDCQCANCLLVVERQRVMAAQVALRRQQATEDKKGLSGKQNNFERKAVYQRQVRAPSLLAKSILEGYRPIPAETYVGGTFPLPPPVSDRMRKRRAFADKELENIMLEREYKEREMLETSQAAALFLPNRMVPGPDYNSYKSAYSPSPVEPPSKDFCNFLPTCLDLTMQYSGSGNMELISSNVSVATTYRQYPLSSRFLVWPKCGPISDTLLYQQCLLNATTSVQALKPGASWDLKGARVQDGLSAEQDMMPSKLEGSLVLPHTPEIQTTRSDLQGHQAVPERSAFSPPRRNFSPIVDTDSLAAQGHVLTKISKENTRHPLPLRHNPFHSLFQQTLTDKSGPELKTPFVKEAFEETPKKHRECLVKDNQKYTFTIDRCAKDLFVAKQVGTKLSVNEPLSFSVESILKRPSSAITRVSQ

SEQ ID NO: 14880 - protein, 472 aa, Homo Sapiens
MNGYGSPYLYMGGPVSQPPRAPLQRTPKCARCRNHGVLSWLKGHKRYCRFKDCTCEKCILIIERQRVMAAQVALRRQQANESLESLIPDSLRALPGPPPPGDAVAAPQPPPASQPSQPQPPRPAAELAAAAALRWTAEPQPGALQAQLAKPDLTEERLGDGKSADNTEVFSDKDTDQRSSPDVAKSKGCFTPESPEIVSVEEGGYAVQKNGGNPESRPDSPKCHAEQNHLLIEGPSGTVSLPFSLKANRPPLEVLKKIFPNQKPTVLELILKGCGGDLVSAVEVLLSSRSSVTGAERTSAEPESLALPSNGHIFEHTLSSYPISSSKWSVGSAFRVPDTLRFSADSSNVVPSPLAGPLQPPFPQPPRYPLMLRNTLARSQSSPFLPNDVTLWNTMTLQQQYQLRSQYVSPFPSNSTSVFRSSPVLPARATEDPRISIPDDGCPFVSKQSIYTEDDYDERSDSSDSRTLNTSS

SEQ ID NO: 14881 - protein, 504 aa, Homo Sapiens
MERSQCGSRDRGVSGRPHLAPGLVVAAPPPPSPALPVPSGMQVPPAFLRPPSLFLRAAAAAAAAAAATSGSGGCPPAPGLESGVGAVGCGYPRTPKCARCRNHGVVSALKGHKRFCRWRDCACAKCTLIAERQRVMAAQVALRRQQAQEESEARGLQRLLCSGLSWPPGGRASGGGGRAENPQSTGGPAAGAALGLGALRQASGSATPAFEVFQQDYPEEKQEQKESKCESCQNGQEELISKSHQLYLGSSSRSNGVIGKQSIGSSISEYSNKPDSILSPHPGEQSGGEESPRSLSSSDLESGNESEWVKDLTATKASLPTVSSRPRDPLDILTKIFPNYRRSRLEGILRFCKGDVVQAIEQVLNGKEHKPDNRNLANSEELENTAFQRASSFSLAGIGFGTLGNKSAFSPLQTTSASYGGDSSLYGVNPRVGISPLRLAYSSAGRGLSGFMSPYLTPGLVPTLPFRPALDYAFSGMIRDSSYLSSKDSITCGRLYFRPNQDNP

SEQ ID NO: 14882 - protein, 542 aa, Homo Sapiens; identical to SEQ ID NO: 4339

SEQ ID NO: 14883 - protein, 342 aa, Homo Sapiens
MADKMVRTPKCSRCRNHGFLVPVKGHAGKCRWKQCLCEKCYLISERQKIMAAQKVLKTQAAEEEQEAALCAQGPKQASGAAAAAPAPVPVPAASLRPLSPGTPSGDADPGPEGRAAACFFEQPPRGRNPGPRALQPVLGGRSHVEPSERAAVAMPSLAGPPFGAEAAGSGYPGPLDLRRPMRTVPGPLFTDFVRPLNINPDRALGPEYPGGSSMHPYCPFPLGYLDAPPGVPLQQGFRHVSRSQYQGGGLVSEPGGDFQPSYYLPPPPPPLPPLPPLPPQPQFLPPGYLSALHFLPPPPPPPPPSSFSLTVLFDTDKENTDDQDAEVLSGEPSQPSSQEQSD

SEQ ID NO: 14884 - protein, 192 aa, Homo Sapiens
MAAPPKAPIRVRNLTIRAGALTGKENNMLQPETHIFTAPEEGSSQGALLLGQAPEPLSLPCTPVTLEQQLVSPSGDPHRAPALPSICSTLILQPCATLDPLLLQPQVPKVSDQALVSAHSEWQRKLEAAEALLTLRNSAQAPPDSISLHQPCNPPAPAGDKGFQPPSPSLRPRPASSISLPIGHLGCISLLS

SEQ ID NO: 14885 - protein, 367 aa, Homo Sapiens
MEPSDMPAGYHCPLDSAPWDETRDPQSTELIPRRAISRSPTCARCRNHGVTAHLKGHKRLCLFQACECHKCVLILERRRVMAAQVALRRQQEAQLKKHLMRRGEASPKAPNHFRKGTTQPQVPSGKENIAPQPQTPHGAVLLAPTPPGKNSCGPLLLSHPPEASPLSWTPVPPGPWVPGHWLPPGFSMPPPVVCRLLYQEPAVSLPPFPGFDPGTSLQLPTHGPFTTCPGSHPVLTAPLSGEPQGPPSQPRTHSTLILQPCGTPDPLQLQPQASGASCLARTSGPSEWQLQQEAAEALVGLKDSSQAPRVTPSVPPNPAWISLLHPCGPPAPAGGRGFQPVGPCLRPSPAPSVALHIGRLGSISLLS

SEQ ID NO: 14886 - protein, 760 aa, Homo Sapiens
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKELRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPVLIKGLKQLHENQKNNPTLLENKSGSGVPNSNTNSSVQHVQIRVARLEDNTAISSSPMAALQIPVQITHVSSADSPATVDSETITLNSGTLQTFEILPSFHLQPTGTPGTYLLQTSSSQGLPLTLTASPTVTLTAAAPASPEQIIVHALSPEHLLNTSDNVTVQCHTPRVIIQTVATEDITSSISQAELTVDSDIQSSDFPEPPDALEADTFPDEIHHPKMTVEPSFNDAHVSKFSDQNSTELMNSVMVRTEEEISDTDLKQEESPSDLASAYVTEGLESPTIEEQVDQTIDDETILIVPSPHGFIQASDVIDTESVLPLTTLTDPILQHHQEESNIIGSSLGSPVSEDSKDVEDLVNCH

SEQ ID NO: 14887 - protein, 554 aa, Homo Sapiens
MTAPCSQPAQLPGRRQLGLVPFPPPPPRTPLLWLLLLLLAAVAPARGWESGDLELFDLVEEVQLNFYQFLGVQQDASSADIRKAYRKLSLTLHPDKNKDENAETQFRQLVAIYEVLKDDERRQRYDDILINGLPDWRQPVFYYRRVRKMSNAELALLLFIILTVGHYAVVWSIYLEKQLDELLSRKKREKKKKTGSKSVDVSKLGASEKNERLLMKPQWHDLLPCKLGIWFCLTLKALPHLIQDAGQFYAKYKETRLKEKEDALTRTELETLQKQKKVKKPKPEFPVYTPLETTYIQSYDHGTSIEEIEEQMDDWLENRNRTQKKQAPEWTEEDLSQLTRSMVKFPGGTPGRWEKIAHELGRSVTDVTTKAKQLKDSVTCSPGMVRLSELKSTVQNSRPIKTATTLPDDMITQREDAEGVAAEEEQEGDSGEQETGATDARPRRRKPARLLEATAKPEPEEKSRAKRQKDFDIAEQNESSDEESLRKERARSAEEPWTQNQQKLLELALQQYPRGSSDRWDKIARCVPSKSKEDCIARYKLLVELVQKKKQAKS

SEQ ID NO: 14888 - protein, 621 aa, Homo Sapiens
MLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAAHKAMVLKHHPDKRKAAGEPIKEGDNDYFTCITKAYEMLSDPVKRRAFNSVDPTFDNSVPSKSEAKDNFFEVFTPVFERNSRWSNKKNVPKLGDMNSSFEDVDIFYSFWYNFDSWREFSYLDEEEKEKAECRDERRWIEKQNRATRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKTWNHFSDNEAERVKMMEEVEKLCDRLELASLQCLNETLTSCTKEVGKAALEKQIEEINEQIRKEKEEAEARMRQASKNTEKSTGGGGNGSKNWSEDDLQLLIKAVNLFPAGTNSRWEVIANYMNIHSSSGVKRTAKDVIGKAKSLQKLDPHQKDDINKKAFDKFKKEHGVVPQADNATPSERFEGPYTDFTPWTTEEQKLLEQALKTYPVNTPERWEKIAEAVPGRTKKDCMKRYKELVEMVKAKKAAQEQVLNASRAKK

SEQ ID NO: 14889 - protein, 531 aa, Homo Sapiens
MKCHYEALGVRRDASEEELKKAYRKLALKWHPDKNLDNAAEAAEQFKLIQAAYDVLSDPQERAWYDNHREALLKGGFDGEYQDDSLDLLRYFTVTCYSGYGDDEKGFYTVYRNVFEMIAKEELESVLEEEVDDFPTFGDSQSDYDTVVHPFYAYWQSFCTQKNFAWKEEYDTRQASNRWEKRAMEKENKKIRDKARKEKNELVRQLVAFIRKRDKRVQAHRKLVEEQNAEKARKAEEMRRQQKLKQAKLVEQYREQSWMTMANLEKELQEMEARYEKEFGDGSDENEMEEHELKDEEDGKDSDEAEDAELYDDLYCPACDKSFKTEKAMKNHEKSKKHREMVALLKQQLEEEEENFSRPQIDENPLDDNSEEEMEDAPKQKLSKKQKKKKQKPAQNYDDNFNVNGPGEGVKVDPEDTNLNQDSAKELEDSPQENVSVTEIIKPCDDPKSEAKSVPKPKGKKTKDMKKPVRVPAEPQTMSVLISCTTCHSEFPSRNKLFDHLKATGHARAPSSSSLNSATSSQSKKEKRKNR

SEQ ID NO: 14890 - protein, 1616 aa, Homo Sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 14891 - protein, 912 aa, Homo Sapiens
MPAMPSSGPGDTSSSAAEREEDRKDGEEQEEPRGKEERQEPSTTARKVGRPGRKRKHPPVESGDTPKDPAVISKSPSMAQDSGASELLPNGDLEKRSEPQPEEGSPAGGQKGGAPAEGEGAAETLPEASRAVENGCCTPKEGRGAPAEAGKEQKETNIESMKMEGSRGRLRGGLGWESSLRQRPMPRLTFQAGDPYYISKRKRDEWLARWKREAEKKAKVIAGMNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 14892 - protein, 853 aa, Homo Sapiens
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPVVNKSKVRRAGSRKLESRKYENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKLKKVQTITTKSNSIKQGKNQLFPVVMNGKEDVLWCTELERIFGFPVHYTDVSNMGRGARQKLLGRSWSVPVIRHLFAPLKDYFACE

SEQ ID NO: 14893 - protein, 386 aa, Homo Sapiens
MAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSRHWALVSEEELSLLAQNKQSSKLAAKWPTKLVKNCFLPLREYFKYFSTELTSSL

SEQ ID NO: 14894 - protein, 380 aa, Homo Sapiens
MGGLSARPTAGRTDPAGTCWGQDPGSKMATVIPGPLSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDKFYKELAWVPEAQRKHTAKKAPDGTVIPNGYCDFCLGGSKKTGCPEDLISCADCGRSGHPSCLQFTVNMTAAVRTYRWQCIECKSCSLCGTSENDGASWAGLTPQDQLLFCDDCDRGYHMYCLSPPMAEPPEGSWSCHLCLRHLKEKASAYITLT

SEQ ID NO: 14895 - protein, 391 aa, Homo Sapiens
MAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDICGKRYKNRPGLSYHYAHSHLAEEEGEDKEDSQPPTPVSQRSEEQKSKKGPDGLALPNNYCDFCLGDSKINKKTGQPEELVSCSDCGRSGHPSCLQFTPVMMAAVKTYRWQCIECKCCNICGTSENDDQLLFCDDCDRGYHMYCLTPSMSEPPEGSWSCHLCLDLLKEKASIYQNQNSS

SEQ ID NO: 14896 - protein, 378 aa, Homo Sapiens; identical to SEQ ID NO: 4419

SEQ ID NO: 14897 - protein, 191 aa, Homo Sapiens
MPGSEDLRKGKDQMHSHRKRTMFTKKQLEDLNILFNENPYPNPSLQKEMASKIDIHPTVLQVWFKNHRAKLKKAKCKHIHQKQETPQPPIPEGGVSTSVGLRNADTLPRLPNAAHPIGLVYTGHRVPSFQLILYPNLKVPANDFIGHRIVHFGCCRDPNIYCLYPILESQVCAPSFHSGSPACSSNQSRER

SEQ ID NO: 14898 - protein, 176 aa, Homo Sapiens
MASSSGNDDDLTIPRAAINKMIKETLPNVRVANDARELVVNCCTEFIHLISSEANEICNKSEKKTISPEHVIQALESLGFGSYISEVKEVLQECKTVALKRRKASSRLENLGIPEEELLRQQQELFAKARQQQAELAQQEWLQMQQAAQQAQLAAASASASNQAGSSQDEEDDDDI

SEQ ID NO: 14899 - protein, 205 aa, Homo Sapiens
MPSKKKKYNARFPPARIKKIMQTDEEIGKVAAAVPVIISRALELFLESLLKKACQVTQSRNAKTMTTSHLKQCIELEQQFDFLKDLVASVPDMQGDGEDNHMDGDKGARRGRKPGSGGRKNGGMGTKSKDKKLSGTDSEQEDESEDTDTDGEEETSQPPPQASHPSAHFQSPPTPFLPFASTLPLPPAPPGPSAPDEEDEEDYDS

SEQ ID NO: 14900 - protein, 263 aa, Homo Sapiens
MFYFHCPPQLEGTATFGNHSSGDFDDGFLRRKQRRNRTTFTLQQLEALEAVFAQTHYPDVFTREELAMKINLTEARVQVWFQNRRAKWRKTERGASDQEPGAKEPMAEVTPPPVRNINSPPPGDQARSKKEALEAQQSLGRTVGPAGPFFPSCLPGTLLNTATYAQALSHVASLKGGPLCSCCVPDPMGLSFLPTYGCQSNRTASVATLRMKAREHSEAVLQSANLLPSTSSSPGPVAKPAPPDGSQEKTSPTKEQSEAEKSV

SEQ ID NO: 14901 - protein, 424 aa, Homo Sapiens
MALPTPSDSTLPAEARGRGRRRRLVWTPSQSEALRACFERNPYPGIATRERLAQAIGIPEPRVQIWFQNERSRQLRQHRRESRPWPGRRGPPEGRRKRTAVTGSQTALLLRAFEKDRFPGIAAREELARETGLPESRIQIWFQNRRARHPGQGGRAPAQAGGLCSAAPGGGHPAPSWVAFAHTGAWGTGLPAPHVPCAPGALPQGAFVSQAARAAPALQPSQAAPAEGISQPAPARGDFAYAAPAPPDGALSHPQAPRWPPHPGKSREDRDPQRDGLPGPCAVAQPGPAQAGPQGQGVLAPPTSQGSPWWGWGRGPQVAGAAWEPQAGAAPPPQPAPPDASASARQGQMQGIPAPSQALQEPAPWSALPCGLLLDELLASPEFLQQAQPLLETEAPGELEASEEAASLEAPLSEEEYRALLEEL

SEQ ID NO: 14902 - protein, 374 aa, Homo Sapiens
MALPTPSDSTLPAEARGRGRRRRLVWTPSQSEALRACFERNPYPGIATRERLAQAIGIPEPRVQIWFQNERSRQLRQHRRESRPWPGRRGPPEGRRKRTAVTGSQTALLLRAFEKDRFPGIAAREELARETGLPESRIQIWFQNRRARHPGQGGRAPAQAGGLCSAAPGGGHPAPSWVAFAHTGAWGTGLPAPHVPCAPGALPQGAFVSQAARAAPALQPSQAAPAEGISQPAPARGDFAYAAPAPPDGALSHPQAPRWPPHPGKSREDRDPQRDGLPGPCAVAQPGPAQAGPQGQGVLAPPTSQGSPWWGWGRGPQVAGAAWEPQAGAAPPPQPAPPDASAASTDASHPGASQPLQEPGRSSTVTSSLLYELL

SEQ ID NO: 14903 - protein, 204 aa, Homo Sapiens
MAEDTYSHKMVKTNHRRCRTKFTEEQLKILINTFNQKPYPGYATKQKLALEINTEESRIQIWFQNRRARHGFQKRPEAETLESSQSQGQDQPGVEFQSREARRCRTTYSASQLHTLIKAFMKNPYPGIDSREELAKEIGVPESRVQIWFQNRRSRLLLQRKREPVASLEQEEQGKIPEGLQGAEDTQNGTNFTSDSHFSGARTW

SEQ ID NO: 14904 - protein, 437 aa, Homo Sapiens
MALAGAPAGGPCAPALEALLGAGALRLLDSSQIVIISAAQDASAPPAPTGPAAPAAGPCDPDLLLFATPQAPRPTPSAPRPALGRPPVKRRLDLETDHQYLAESSGPARGRGRHPGKGVKSPGEKSRYETSLNLTTKRFLELLSHSADGVVDLNWAAEVLKVQKRRIYDITNVLEGIQLIAKKSKNHIQWLGSHTTVGVGGRLEGLTQDLRQLQESEQQLDHLMNICTTQLRLLSEDTDSQRLAYVTCQDLRSIADPAEQMVMVIKAPPETQLQAVDSSENFQISLKSKQGPIDVFLCPEETVGGISPGKTPSQEVTSEEENRATDSATIVSPPPSSPPSSLTTDPSQSLLSLEQEPLLSRMGSLRAPVDEDRLSPLVAADSLLEHVREDFSGLLPEEFISLSPPHEALDYHFGLEEGEGIRDLFDCDFGDLTPLDF

SEQ ID NO: 14905 - protein, 437 aa, Homo Sapiens
MLQGPRALASAAGQTPKVVPAMSPTELWPSGLSSPQLCPATATYYTPLYPQTAPPAAAPGTCLDATPHGPEGQVVRCLPAGRLPAKRKLDLEGIGRPVVPEFPTPKGKCIRVDGLPSPKTPKSPGEKTRYDTSLGLLTKKFIYLLSESEDGVLDLNWAAEVLDVQKRRIYDITNVLEGIQLIRKKAKNNIQWVGRGMFEDPTRPGKQQQLGQELKELMNTEQALDQLIQSCSLSFKHLTEDKANKRLAYVTYQDIRAVGNFKEQTVIAVKAPPQTRLEVPDRTEDNLQIYLKSTQGPIEVYLCPEEVQEPDSPSEEPLPSTSTLCPSPDSAQPSSSTDPSIMEPTASSVPAPAPTPQQAPPPPSLVPLEATDSLLELPHPLLQQTEDQFLSPTLACSSPLISFSPSLDQDDYLWGLEAGEGISDLFDSYDLGDLLIN

SEQ ID NO: 14906 - protein, 465 aa, Homo Sapiens
MRKGIQPALEQYLVTAGGGEGAAVVAAAAAASMDKRALLASPGFAAAAAAAAAPGAYIQILTTNTSTTSCSSSLQSGAVAAGPLLPSAPGAEQTAGSLLYTTPHGPSSRAGLLQQPPALGRGGSGGGGGPPAKRRLELGESGHQYLSDGLKTPKGKGRAALRSPDSPKTPKSPSEKTRYDTSLGLLTKKFIQLLSQSPDGVLDLNKAAEVLKVQKRRIYDITNVLEGIHLIKKKSKNNVQWMGCSLSEDGGMLAQCQGLSKEVTELSQEEKKLDELIQSCTLDLKLLTEDSENQRLAYVTYQDIRKISGLKDQTVIVVKAPPETRLEVPDSIESLQIHLASTQGPIEVYLCPEETETHSPMKTNNQDHNGNIPKPASKDLASTNSGHSDCSVSMGNLSPLASPANLLQQTEDQIPSNLEGPFVNLLPPLLQEDYLLSLGEEEGISDLFDAYDLEKLPLVEDFMCS

SEQ ID NO: 14907 - protein, 413 aa, Homo Sapiens
MAEAGPQAPPPPGTPSRHEKSLGLLTTKFVSLLQEAKDGVLDLKLAADTLAVRQKRRIYDITNVLEGIGLIEKKSKNSIQWKGVGPGCNTREIADKLIELKAEIEELQQREQELDQHKVWVQQSIRNVTEDVQNSCLAYVTHEDICRCFAGDTLLAIRAPSGTSLEVPIPEGLNGQKKYQIHLKSVSGPIEVLLVNKEAWSSPPVAVPVPPPEDLLQSPSAVSTPPPLPKPALAQSQEASRPNSPQLTPTAVPGSAEVQGMAGPAAEITVSGGPGTDSKDSGELSSLPLGPTTLDTRPLQSSALLDSSSSSSSSSSSSSNSNSSSSSGPNPSTSFEPIKADPTGVLELPKELSEIFDPTRECMSSELLEELMSSEVFAPLLRLSPPPGDHDYIYNLDESEGVCDLFDVPVLNL

SEQ ID NO: 14908 - protein, 346 aa, Homo Sapiens; identical to SEQ ID NO: 4477

SEQ ID NO: 14909 - protein, 281 aa, Homo Sapiens
MSQQRPARKLPSLLLDPTEETVRRRCRDPINVEGLLPSKIRINLEDNVQYVSMRKALKVKRPRFDVSLVYLTRKFMDLVRSAPGGILDLNKVATKLGVRKRRVYDITNVLDGIDLVEKKSKNHIRWIGSDLSNFGAVPQQKKLQEELSDLSAMEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 14910 - protein, 911 aa, Homo Sapiens
MEVNCLTLKDLISPRQPRLDFAVEDGENAQKENIFVDRSRMAPKTPIKNEPIDLSKQKKFTPERNPITPVKFVDRQQAEPWTPTANLKMLISAASPDIRDREKKKGLFRPIENKDDAFTDSLQLDVVGDSAVDEFEKQRPSRKQKSLGLLCQKFLARYPSYPLSTEKTTISLDEVAVSLGVERRRIYDIVNVLESLHLVSRVAKNQYGWHGRHSLPKTLRNLQRLGEEQKYEEQMAYLQQKELDLIDYKFGERKKDGDPDSQEQQLLDFSEPDCPSSSANSRKDKSLRIMSQKFVMLFLVSKTKIVTLDVAAKILIEESQDAPDHSKFKTKVRRLYDIANVLTSLALIKKVHVTEERGRKPAFKWIGPVDFSSSDEELVDVSASVLPELKRETYGQIQVCAKQKLARHGSFNTVQASERIQRKVNSEPSSPYREEQGSGGYSLEIGSLAAVYRQKIEDNSQGKAFASKRVVPPSSSLDPVAPFPVLSVDPEYCVNPLAHPVFSVAQTDLQAFSMQNGLNGQVDVSLASAASAVESLKPALLAGQPLVYVPSASLFMLYGSLQEGPASGSGSERDDRSSEAPATVELSSAPSAQKRLCEERKPQEEDEPATKRQSREYEDGPLSLVMPKKPSDSTDLASPKTMGNRASIPLKDIHVNGQLPAAEEISGKATANSLVSSEWGNPSRNTDVEKPSKENESTKEPSLLQYLCVQSPAGLNGFNVLLSGSQTPPTVGPSSGQLPSFSVPCMVLPSPPLGPFPVLYSPAMPGPVSSTLGALPNTGPVNFSLPGLGSIAQLLVGPTAVVNPKSSTLPSADPQLQSQPSLNLSPVMSRSHSVVQQPESPVYVGHPVSVVKLHQSPVPVTPKSIQRTHRETFFKTPGSLGDPVLKRRERNQSRNTSSAQRRLEIPSGGAD

SEQ ID NO: 14911 - protein, 867 aa, Homo Sapiens
MENEKENLFCEPHKRGLMKTPLKESTTANIVLAEIQPDFGPLTTPTKPKEGSQGEPWTPTANLKMLISAVSPEIRNRDQKRGLFDNRSGLPEAKDCIHEHLSGDEFEKSQPSRKEKSLGLLCHKFLARYPNYPNPAVNNDICLDEVAEELNVERRRIYDIVNVLESLHMVSRLAKNRYTWHGRHNLNKTLGTLKSIGEENKYAEQIMMIKKKEYEQEFDFIKSYSIEDHIIKSNTGPNGHPDMCFVELPGVEFRAASVNSRKDKSLRVMSQKFVMLFLVSTPQIVSLEVAAKILIGEDHVEDLDKSKFKTKIRRLYDIANVLSSLDLIKKVHVTEERGRKPAFKWTGPEISPNTSGSSPVIHFTPSDLEVRRSSKENCAKNLFSTRGKPNFTRHPSLIKLVKSIESDRRKINSAPSSPIKTNKAESSQNSAPFPSKMAQLAAICKMQLEEQSSESRQKVKVQLARSGPCKPVAPLDPPVNAEMELTAPSLIQPLGMVPLIPSPLSSAVPLILPQAPSGPSYAIYLQPTQAHQSVTPPQGLSPTVCTTHSSKATGSKDSTDATTEKAANDTSKASASTRPGSLLPAPERQGAKSRTREPAGERGSKRASMLEDSGSKKKFKEDLKGLENVSATLFPSGYLIPLTQCSSLGAESILSGKENSSALSPNHRIYSSPIAGVIPVTSSELTAVNFPSFHVTPLKLMVSPTSVAAVPVGNSPALASSHPVPIQNPSSAIVNFTLQHLGLISPNVQLSASPGSGIVPVSPRIESVNVAPENAGTQQGRATNYDSPVPGQSQPNGQSVAVTGAQQPVPVTPKGSQLVAESFFRTPGGPTKPTSSSCMDFEGANKTSLGTLFVPQRKLEVSTEDVH

SEQ ID NO: 14912 - protein, 784 aa, Homo Sapiens
MEGAMAVRVTAAHTAEAQAEAGREAGEGAVAAVAAALAPSGFLGLPAPFSEEDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPRQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARAGSGAGAAGLGTATSSVTGEPIETSPVIHLVTDAKGTVIHEVHVQMQELSLGMKALAPEPPVSQELPCSSEGSRENLLHQAMQNSGIVLERAAGEEGALEPAPAAGSSPQPLAVAAPQLPVLEVQPLETQVASEASAVPRTHPCPQCSETFPTAATLEAHKRGHTGPRPFACAQCGKAFPKAYLLKKHQEVHVRERRFRCGDCGKLYKTIAHVRGHRRVHSDERPYPCPKCGKRYKTKNAQQVHFRTHLEEKPHVCQFCSRGFREKGSLVRHVRHHTGEKPFKCYKCGRGFAEHGTLNRHLRTKGGCLLEVEELLVSEDSPAAATTVLTEDPHTVLVEFSSVVADTQEYIIEATADDAETSEATEIIEGTQTEVDSHIMKVVQQIVHQASAGHQIIVQNVTMDEETALGPEAAAADTITIATPESLTEQVAMTLASAISEGTVLAARAGTSGTEQATVTMVSSEDIEILEHAGELVIASPEGQLEVQTVIV

SEQ ID NO: 14913 - protein, 591 aa, Homo Sapiens
MFGIQESIQRSGSSMKEEPLGSGMNAVRTWMQGAGVLDANTAAQSGVGLARAHFEKQPPSNLRKSNFFHFVLALYDRQGQPVEIERTAFVGFVEKEKEANSEKTNNGIHYRLQLLYSNGIRTEQDFYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEGTPSYLEHATPCIKAISPSEGWTTGGATVIIIGDNFFDGLQVIFGTMLVWSELITPHAIRVQTPPRHIPGVVEVTLSYKSKQFCKGTPGRFIYTALNEPTIDYGFQRLQKVIPRHPGDPERLPKEVILKRAADLVEALYGMPHNNQEIILKRAADIAEALYSVPRNHNQLPALANTSVHAGMMGVNSFSGQLAVNVSEASQATNQGFTRNSSSVSPHGYVPSTTPQQTNYNSVTTSMNGYGSAAMSNLGGSPTFLNGSAANSPYAIVPSSPTMASSTSLPSNCSSSSGIFSFSPANMVSAVKQKSAFAPVVRPQTSPPPTCTSTNGNSLQAISGMIVPPM

SEQ ID NO: 14914 - protein, 575 aa, Homo Sapiens
MFGIQDTLGRGPTLKEKSLGAEMDSVRSWVRNVGVVDANVAAQSGVALSRAHFEKQPPSNLRKSNFFHFVLALYDRQGQPVEIERTAFVDFVENDKEQGNEKTNNGTHYKLQLLYSNGVRTEQDLYVRLIDSVTKQPIAYEGQNKNPEMCRVLLTHEVMCSRCCEKKSCGNRNETPSDPVIIDRFFLKFFLKCNQNCLKTAGNPRDMRRFQVVLSTTVNVDGHVLAVSDNMFVHNNSKHGRRARRLDPSEATPCIKAISPSEGWTTGGAMVIIIGDNFFDGLQVVFGTMLVWSELITPHAIRVQTPPRHIPGVVEVTLSYKSKQFCKGAPGRFIYTALNEPTIDYGFQRLQKVIPRHPGDPERLAKEMLLKRAADLVEALYGTPHNNQDIILKRAADIAEALYSVPRNPSQLPALSSSPAHSGMMGINSYGSQLGVSISESTQGNNQGYIRNTSSISPRGYSSSSTPQQSNYSTSSNSMNGYSNVPMANLGVPGSPGFLNGSPTGSPYGIMSSSPTVGSSSTSSILPFSSSVFPAVKQKSAFAPVIRPQGSPSPACSSGNGNGFRAMTGLVVPPM

SEQ ID NO: 14915 - protein, 596 aa, Homo Sapiens
MFGIQENIPRGGTTMKEEPLGSGMNPVRSWMHTAGVVDANTAAQSGVGLARAHFEKQPPSNLRKSNFFHFVLALYDRQGQPVEIERTAFVDFVEKEKEPNNEKTNNGIHYKLQLLYSNGVRTEQDLYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEGTAPSYLENATPCIKAISPSEGWTTGGATVIIIGDNFFDGLQVVFGTMLVWSELITPHAIRVQTPPRHIPGVVEVTLSYKSKQFCKGAPGRFVYTALNEPTIDYGFQRLQKVIPRHPGDPERLPKEVLLKRAADLVEALYGMPHNNQEIILKRAADIAEALYSVPRNHNQIPTLGNNPAHTGMMGVNSFSSQLAVNVSETSQANDQVGYSRNTSSVSPRGYVPSSTPQQSNYNTVSTSMNGYGSGAMASLGVPGSPGFLNGSSANSPYGIVPSSPTMAASSVTLPSNCSSTHGIFSFSPANVISAVKQKSAFAPVVRPQASPPPSCTSANGNGLQAMSGLVVPPM

SEQ ID NO: 14916 - protein, 602 aa, Homo Sapiens
MFPAQDALPRSGLNLKEEPLLPAGLGSVRSWMQGAGILDASTAAQSGVGLARAHFEKQPPSNLRKSNFFHFVLAMYDRQGQPVEVERTAFIDFVEKDREPGAEKTNNGIHYRLRLVYNNGLRTEQDLYVRLIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAIMPSSPPLAAASSMSLPAAAPTTSVFSFSPVNMISAVKQRSAFAPVLRPPSSPPQACPRAHGEGLPDQSFEDSDKFHSPARGLQGLAYS

SEQ ID NO: 14917 - protein, 706 aa, Homo Sapiens
MTTLKEAVTFKDVAVVFTEEELRLLDLAQRKLYREVMLENFRNLLSVGHQSLHRDTFHFLKEEKFWMMETATQREGNLGGKIQMEMETVSESGTHEGLFSHQTWEQISSDLTRFQDSMVNSFQFSKQDDMPCQVDAGLSIIHVRQKPSEGRTCKKSFSDVSVLDLHQQLQSREKSHTCDECGKSFCYSSALRIHQRVHMGEKLYNCDVCGKEFNQSSHLQIHQRIHTGEKPFKCEQCGKGFSRRSGLYVHRKLHTGVKPHICEKCGKAFIHDSQLQEHQRIHTGEKPFKCDICCKSFRSRANLNRHSMVHMREKPFRCDTCGKSFGLKSALNSHRMVHTGEKRYKCEECGKRFIYRQDLYKHQIDHTGEKPYNCKECGKSFRWASGLSRHVRVHSGETTFKCEECGKGFYTNSQRYSHQRAHSGEKPYRCEECGKGYKRRLDLDFHQRVHRGEKPYNCKECGKSFGWASCLLNHQRIHSGEKPFKCEECGKRFTQNSQLYTHRRVHSGEKPFKCEECGKRFTQNSQLYSHRRVHTGVKPYKCEECGKGFNSKFNLDMHQRVHTGERPYNCKECGKSFSRASSILNHKRLHGDEKPFKCEECGKRFTENSQLHSHQRVHTGEKPYKCEKCGKSFRWASTHLTHQRLHSREKLLQCEDCGKSIVHSSCLKDQQRDQSGEKTSKCEDCGKRYKRRLNLDTLLSLFLNDT

SEQ ID NO: 14918 - protein, 476 aa, Homo Sapiens
MMTAKAVDKIPVTLSGFVHQLSDNIYPVEDLAATSVTIFPNAELGGPFDQMNGVAGDGMINIDMTGEKRSLDLPYPSSFAPVSAPRNQTFTYMGKFSIDPQYPGASCYPEGIINIVSAGILQGVTSPASTTASSSVTSASPNPLATGPLGVCTMSQTQPDLDHLYSPPPPPPPYSGCAGDLYQDPSAFLSAATTSTSSSLAYPPPPSYPSPKPATDPGLFPMIPDYPGFFPSQCQRDLHGTAGPDRKPFPCPLDTLRVPPPLTPLSTIRNFTLGGPSAGVTGPGASGGSEGPRLPGSSSAAAAAAAAAAYNPHHLPLRPILRPRKYPNRPSKTPVHERPYPCPAEGCDRRFSRSDELTRHIRIHTGHKPFQCRICMRNFSRSDHLTTHIRTHTGEKPFACDYCGRKFARSDERKRHTKIHLRQKERKSSAPSASVPAPSTASCSGGVQPGGTLCSSNSSSLGGGPLAPCSSRTRTP

SEQ ID NO: 14919 - protein, 387 aa, Homo Sapiens
MTGKLAEKLPVTMSSLLNQLPDNLYPEEIPSALNLFSGSSDSVVHYNQMATENVMDIGLTNEKPNPELSYSGSFQPAPGNKTVTYLGKFAFDSPSNWCQDNIISLMSAGILGVPPASGALSTQTSTASMVQPPQGDVEAMYPALPPYSNCGDLYSEPVSFHDPQGNPGLAYSPQDYQSAKPALDSNLFPMIPDYNLYHHPNDMGSIPEHKPFQGMDPIRVNPPPITPLETIKAFKDKQIHPGFGSLPQPPLTLKPIRPRKYPNRPSKTPLHERPHACPAEGCDRRFSRSDELTRHLRIHTGHKPFQCRICMRSFSRSDHLTTHIRTHTGEKPFACEFCGRKFARSDERKRHAKIHLKQKEKKAEKGGAPSASSAPPVSLAPVVTTCA

SEQ ID NO: 14920 - protein, 589 aa, Homo Sapiens
MAVARGVGSPEPAPPQLYKWGGCGLGEPGSALERRGAAARGRCGRARAPRLPDSFPRGECPKPGARAPRSVRCGEPLPPASPPPARPQAQRARPRAPHSRRRAMLHLSEFSEPDALLVKSTEGCCAEPSAELPRLPARDAPAATGYPGAGDFLSWALNSCGASGDLADSCFLEGPAPTPPPGLSYSGSFFIQAVPEHPHDPEALFNLMSGILGLAPFPGPEAAASRSPLDAPFPAGSDALLPGPPDLYSPDLGAAPFPEAFWEASPCAGAPSQCLYEPQLSPPDVKPGLRAPPASPALDAVSAFKGPYAPWELLSVGAPGNCGSQGDYQAAPEARFPVIGTKIEDLLSISCPAELPAVPANRLYPSGAYDAFPLAPGDLGEGAEGLPGLLTPPSGEGGSSGDGGEFLASTQPQLSPLGLRSAAAADFPKPLVADIPGSSGVAAPPVPPPPPTPFPQAKARRKGRRGGKCSTRCFCPRPHAKAFACPVESCVRSFARSDELNRHLRIHTGHKPFQCRICLRNFSRSDHLTTHVRTHTGEKPFACDVCGRRFARSDEKKRHSKVHLKQKARAEERLKGLGFYSLGLSFASL

SEQ ID NO: 14921 - protein, 300 aa, Homo Sapiens; identical to SEQ ID NO: 4633

SEQ ID NO: 14922 - protein, 619 aa, Homo Sapiens
MAAVVQQNDLVFEFASNVMEDERQLGDPAIFPAVIVEHVPGADILNSYAGLACVEEPNDMITESSLDVAEEEIIDDDDDDITLTVEASCHDGDETIETIEAAEALLNMDSPGPMLDEKRINNNIFSSPEDDMVVAPVTHVSVTLDGIPEVMETQQVQEKYADSPGASSPEQPKRKKGRKTKPPRPDSPATTPNISVKKKNKDGKGNTIYLWEFLLALLQDKATCPKYIKWTQREKGIFKLVDSKAVSRLWGKHKNKPDMNYETMGRALRYYYQRGILAKVEGQRLVYQFKEMPKDLIYINDEDPSSSIESSDPSLSSSATSNRNQTSRSRVSSSPGVKGGATTVLKPGNSKAAKPKDPVEVAQPSEVLRTVQPTQSPYPTQLFRTVHVVQPVQAVPEGEAARTSTMQDETLNSSVQSIRTIQAPTQVPVVVSPRNQQLHTVTLQTVPLTTVIASTDPSAGTGSQKFILQAIPSSQPMTVLKENVMLQSQKAGSPPSIVLGPAQVQQVLTSNVQTICNGTVSVASSPSFSATAPVVTFSPRSSQLVAHPPGTVITSVIKTQETKTLTQEVEKKESEDHLKENTEKTEQQPQPYVMVVSSSNGFTSQVAMKQNELLEPNSF

SEQ ID NO: 14923 - protein, 593 aa, Homo Sapiens
MTSAVVDSGGTILELSSNGVENQEESEKVSEYPAVIVEPVPSARLEQGYAAQVLVYDDETYMMQDVAEEQEVETENVETVEASVHSSNAHCTDKTIEAAEALLHMESPTCLRDSRSPVEVFVPPCVSTPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 14924 - protein, 371 aa, Homo Sapiens
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 14925 - protein, 663 aa, Homo Sapiens
MAITLQPSDLIFEFASNGMDDDIHQLEDPSVFPAVIVEQVPYPDLLHLYSGLELDDVHNGIITDGTLCMTQDQILEGSFLLTDDNEATSHTMSTAEVLLNMESPSDILDEKQIFSTSEMLPDSDPAPAVTLPNYLFPASEPDALNRAGDTSDQEGHSLEEKASREESAKKTGKSKKRIRKTKGNRSTSPVTDPSIPIRKKSKDGKGSTIYLWEFLLALLQDRNTCPKYIKWTQREKGIFKLVDSKAVSKLWGKQKNKPDMNYETMGRALRYYYQRGILAKVEGQRLVYQFKEMPKDLVVIEDEDESSEATAAPPQASTASVASASTTRRTSSRVSSRSAPQGKGSSSWEKPKIQHVGLQPSASLELGPSLDEEIPTTSTMLVSPAEGQVKLTKAVSASSVPSNIHLGVAPVGSGSALTLQTIPLTTVLTNGPPASTTAPTQLVLQSVPAASTFKDTFTLQASFPLNASFQDSQVAAPGAPLILSGLPQLLAGANRPTNPAPPTVTGAGPAGPSSQPPGTVIAAFIRTSGTTAAPRVKEGPLRSSSYVQGMVTGAPMEGLLVPEETLRELLRDQAHLQPLPTQVVSRGSHNPSLLGNQTLSPPSRPTVGLTPVAELELSSGSGSLLMAEPSVTTSGSLLTRSPTPAPFSPFNPTSLIKMEPHDI

SEQ ID NO: 14926 - protein, 265 aa, Homo Sapiens
MPSLPHSHRVMLDSVTHSTFLPNASFCDPLMSWTDLFSNEEYYPAFEHQTACDSYWTSVHPEYWTKRHVWEWLQFCCDQYKLDTNCISFCNFNISGLQLCSMTQEEFVEAAGLCGEYLYFILQNIRTQGYSFFNDAEESKATIKDYADSNCLKTSGIKSQDCHSHSRTSLQSSHLWEFVRDLLLSPEENCGILEWEDREQGIFRVVKSEALAKMWGQRKKNDRMTYEKLSRALRYYYKTGILERVDRRLVYKFGKNAHGWQEDKL

SEQ ID NO: 14927 - protein, 428 aa, Homo Sapiens
MDPSVTLWQFLLQLLREQGNGHIISWTSRDGGEFKLVDAEEVARLWGLRKNKTNMNYDKLSRALRYYYDKNIIRKVSGQKFVYKFVSYPEVAGCSTEDCPPQPEVSVTSTMPNVAPAAIHAAPGDTVSGKPGTPKGAGMAGPGGLARSSRNEYMRSGLYSTFTIQSLQPQPPPHPRPAVVLPSAAPAGAAAPPSGSRSTSPSPLEACLEAEEAGLPLQVILTPPEAPNLKSEELNVEPGLGRALPPEVKVEGPKEELEVAGERGFVPETTKAEPEVPPQEGVPARLPAVVMDTAGQAGGHAASSPEISQPQKGRKPRDLELPLSPSLLGGPGPERTPGSGSGSGLQAPGPALTPSLLPTHTLTPVLLTPSSLPPSIHFWSTLSPIAPRSPAKLSFQFPSSGSAQVHIPSISVDGLSTPVVLSPGPQKP

SEQ ID NO: 14928 - protein, 407 aa, Homo Sapiens
MESAITLWQFLLQLLLDQKHEHLICWTSNDGEFKLLKAEEVAKLWGLRKNKTNMNYDKLSRALRYYYDKNIIKKVIGQKFVYKFVSFPEILKMDPHAVEISRESLLLQDSDCKASPEGREAHKHGLAALRSTSRNEYIHSGLYSSFTINSLQNPPDAFKAIKTEKLEEPPEDSPPVEEVRTVIRFVTNKTDKHVTRPVVSLPSTSEAAAASAFLASSVSAKISSLMLPNAASISSASPFSSRSPSLSPNSPLPSEHRSLFLEAACHDSDSLEPLNLSSGSKTKSPSLPPKAKKPKGLEISAPPLVLSGTDIGSIALNSPALPSGSLTPAFFTAQTPNGLLLTPSPLLSSIHFWSSLSPVAPLSPARLQGPSTLFQFPTLLNGHMPVPIPSLDRAASPVLLSSNSQKS

SEQ ID NO: 14929 - protein, 431 aa, Homo Sapiens
MDSAITLWQFLLQLLQKPQNKHMICWTSNDGQFKLLQAEEVARLWGIRKNKPNMNYDKLSRALRYYYVKNIIKKVNGQKFVYKFVSYPEILNMDPMTVGRIEGDCESLNFSEVSSSSKDVENGGKDKPPQPGAKTSSRNDYIHSGLYSSFTLNSLNSSNVKLFKLIKTENPAEKLAEKKSPQEPTPSVIKFVTTPSKKPPVEPVAATISIGPSISPSSEETIQALETLVSPKLPSLEAPTSASNVMTAFATTPPISSIPPLQEPPRTPSPPLSSHPDIDTDIDSVASQPMELPENLSLEPKDQDSVLLEKDKVNNSSRSKKPKGLELAPTLVITSSDPSPLGILSPSLPTASLTPAFFSQTPIILTPSPLLSSIHFWSTLSPVAPLSPARLQGANTLFQFPSVLNSHGPFTLSGLDGPSTPGPFSPDLQKT

SEQ ID NO: 14930 - protein, 1045 aa, Homo Sapiens
MNLQAQPKAQNKRKRCLFGGQEPAPKEQPPPLQPPQQSIRVKEEQYLGHEGPGGAVSTSQPVELPPPSSLALLNSVVYGPERTSAAMLSQQVASVKWPNSVMAPGRGPERGGGGGVSDSSWQQQPGQPPPHSTWNCHSLSLYSATKGSPHPGVGVPTYYNHPEALKREKAGGPQLDRYVRPMMPQKVQLEVGRPQAPLNSFHAAKKPPNQSLPLQPFQLAFGHQVNRQVFRQGPPPPNPVAAFPPQKQQQQQQPQQQQQQQQAALPQMPLFENFYSMPQQPSQQPQDFGLQPAGPLGQSHLAHHSMAPYPFPPNPDMNPELRKALLQDSAPQPALPQVQIPFPRRSRRLSKEGILPPSALDGAGTQPGQEATGNLFLHHWPLQQPPPGSLGQPHPEALGFPLELRESQLLPDGERLAPNGREREAPAMGSEEGMRAVSTGDCGQVLRGGVIQSTRRRRRASQEANLLTLAQKAVELASLQNAKDGSGSEEKRKSVLASTTKCGVEFSEPSLATKRAREDSGMVPLIIPVSVPVRTVDPTEAAQAGGLDEDGKGPEQNPAEHKPSVIVTRRRSTRIPGTDAQAQAEDMNVKLEGEPSVRKPKQRPRPEPLIIPTKAGTFIAPPVYSNITPYQSHLRSPVRLADHPSERSFELPPYTPPPILSPVREGSGLYFNAIISTSTIPAPPPITPKSAHRTLLRTNSAEVTPPVLSVMGEATPVSIEPRINVGSRFQAEIPLMRDRALAAADPHKADLVWQPWEDLESSREKQRQVEDLLTAACSSIFPGAGTNQELALHCLHESRGDILETLNKLLLKKPLRPHNHPLATYHYTGSDQWKMAERKLFNKGIAIYKKDFFLVQKLIQTKTVAQCVEFYYTYKKQVKIGRNGTLTFGDVDTSDEKSAQEEVEVDIKTSQKFPRVPLPRRESPSEERLEPKREVKEPRKEGEEEVPEIQEKEEQEEGRERSRRAAAVKATQTLQANESASDILILRSHESNAPGSAGGQASEKPREGTGKSRRALPFSEKKKKTETFSKTQNQENTFPCKKCGR

SEQ ID NO: 14931 - protein, 257 aa, Homo Sapiens
MFQPAAKRGFTIESLVAKDGGTGGGTGGGGAGSHLLAAAASEEPLRPTALNYPHPSAAEAAFVSGFPAAAAAGAGRSLYGGPELVFPEAMNHPALTVHPAHQLGASPLQPPHSFFGAQHRDPLHFYPWVLRNRFFGHRFQASDVPQDGLLLHGPFARKPKRIRTAFSPSQLLRLERAFEKNHYVVGAERKQLAGSLSLSETQVKVWFQNRRTKYKRQKLEEEGPESEQKKKGSHHINRWRIATKQANGEDIDVTSND

SEQ ID NO: 14932 - protein, 252 aa, Homo Sapiens
MFQPAPKRCFTIESLVAKDSPLPASRSEDPIRPAALSYANSSPINPFLNGFHSAAAAAAGRGVYSNPDLVFAEAVSHPPNPAVPVHPVPPPHALAAHPLPSSHSPHPLFASQQRDPSTFYPWLIHRYRYLGHRFQGNDTSPESFLLHNALARKPKRIRTAFSPSQLLRLEHAFEKNHYVVGAERKQLAHSLSLTETQVKVWFQNRRTKFKRQKLEEEGSDSQQKKKGTHHINRWRIATKQASPEEIDVTSDD

SEQ ID NO: 14933 - protein, 392 aa, Homo Sapiens
MEEQQPEPKSQRDSALGAAAAATPGGLSLSLSPGASGSSGSGSDGDSVPVSPQPAPPSPPAAPCLPPLAHHPHLPPHPPPPPPQHLAAPAHQPQPAAQLHRTTNFFIDNILRPDFGCKKEQPPPQLLVAAAARGGAGGGGRVERDRGQTAAGRDPVHPLGTRAPGAASLLCAPDANCGPPDGSQPAAAGAGASKAGNPAAAAAAAAAAVAAAAAAAAAKPSDTGGGGSGGGAGSPGAQGTKYPEHGNPAILLMGSANGGPVVKTDSQQPLVWPAWVYCTRYSDRPSSGPRTRKLKKKKNEKEDKRPRTAFTAEQLQRLKAEFQANRYITEQRRQTLAQELSLNESQIKIWFQNKRAKIKKATGIKNGLALHLMAQGLYNHSTTTVQDKDESE

SEQ ID NO: 14934 - protein, 333 aa, Homo Sapiens
MEENDPKPGEAAAAVEGQRQPESSPGGGSGGGGGSSPGEADTGRRRALMLPAVLQAPGNHQHPHRITNFFIDNILRPEFGRRKDAGTCCAGAGGGRGGGAGGEGGASGAEGGGGAGGSEQLLGSGSREPRQNPPCAPGAGGPLPAAGSDSPGDGEGGSKTLSLHGGAKKGGDPGGPLDGSLKARGLGGGDLSVSSDSDSSQAGANLGAQPMLWPAWVYCTRYSDRPSSGPRSRKPKKKNPNKEDKRPRTAFTAEQLQRLKAEFQTNRYLTEQRRQSLAQELSLNESQIKIWFQNKRAKIKKATGNKNTLAVHLMAQGLYNHSTTAKEGKSDSE

SEQ ID NO: 14935 - protein, 434 aa, Homo Sapiens
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 14936 - protein, 686 aa, Homo Sapiens
MQLGEQLLVSSVNLPGAHFYPLESARGGSGGSAGHLPSAAPSPQKLDLDKASKKFSGSLSCEAVSGEPAAASAGAPAAMLSDTDAGDAFASAAAVAKPGPPDGRKGSPCGEEELPSAAAAAAAAAAAAAATARYSMDSLSSERYYLQSPGPQGSELAAPCSLFPYQAAAGAPHGPVYPAPNGARYPYGSMLPPGGFPAAVCPPGRAQFGPGAGAGSGAGGSSGGGGGPGTYQYSQGAPLYGPYPGAAAAGSCGGLGGLGVPGSGFRAHVYLCNRPLWLKFHRHQTEMIITKQGRRMFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 14937 - protein, 870 aa, Homo Sapiens
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGSGFGKKSKDMSTERDFFMRMKCTVTNRGRTVNLKSATWKVLHCTGQVKVYNNCPPHNSLCGYKEPLLSCLIIMCEPIQHPSHMDIPLDSKTFLSRHSMDMKFTYCDDRITELIGYHPEELLGRSAYEFYHALDSENMTKSHQNLCTKGQVVSGQYRMLAKHGGYVWLETQGTVIYNPRNLQPQCIMCVNYVLSEIEKNDVVFSMDQTESLFKPHLMAMNSIFDSSGKGAVSEKSNFLFTKLKEEPEELAQLAPTPGDAIISLDFGNQNFEESSAYGKAILPPSQPWATELRSHSTQSEAGSLPAFTVPQAAAPGSTTPSATSSSSSCSTPNSPEDYYTSLDNDLKIEVIEKLFAMDTEAKDQCSTQTDFNELDLETLAPYIPMDGEDFQLSPICPEERLLAENPQSTPQHCFSAMTNIFQPLAPVAPHSPFLLDKFQQQLESKKTEPEHRPMSSIFFDAGSKASLPPCCGQASTPLSSMGGRSNTQWPPDPPLHFGPTKWAVGDQRTEFLGAAPLGPPVSPPHVSTFKTRSAKGFGARGPDVLSPAMVALSNKLKLKRQLEYEEQAFQDLSGGDPPGGSTSHLMWKRMKNLRGGSCPLMPDKPLSANVPNDKFTQNPMRGLGHPLRHLPLPQPPSAISPGENSKSRFPPQCYATQYQDYSLSSAHKVSGMASRLLGPSFESYLLPELTRYDCEVNVPVLGSSTLLQGGDLLRALDQAT

SEQ ID NO: 14938 - protein, 548 aa, Homo Sapiens
MKTPADTGFAFPDWAYKPESSPGSRQIQLWHFILELLRKEEYQGVIAWQGDYGEFVIKDPDEVARLWGVRKCKPQMNYDKLSRALRYYYNKRILHKTKGKRFTYKFNFNKLVLVNYPFIDVGLAGGAVPQSAPPVPSGGSHFRFPPSTPSEVLSPTEDPRSPPACSSSSSSLFSAVVARRLGRGSVSDCSDGTSELEEPLGEDPRARPPGPPDLGAFRGPPLARLPHDPGVFRVYPRPRGGPEPLSPFPVSPLAGPGSLLPPQLSPALPMTPTHLAYTPSPTLSPMYPSGGGGPSGSGGGSHFSFSPEDMKRYLQAHTQSVYNYHLSPRAFLHYPGLVVPQPQRPDKCPLPPMAPETPPVPSSASSSSSSSSSPFKFKLQPPPLGRRQRAAGEKAVAGADKSGGSAGGLAEGAGALAPPPPPPQIKVEPISEGESEEVEVTDISDEDEEDGEVFKTPRAPPAPPKPEPGEAPGASQCMPLKLRFKRRWSEDCRLEGGGGPAGGFEDEGEDKKVRGEGPGEAGGPLTPRRVSSDLQHATAQLSLEHRDS

SEQ ID NO: 14939 - protein, 486 aa, Homo Sapiens
MIQTVPDPAAHIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTGGAAFIFPNTSVYPEATQRITTRPDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 14940 - protein, 1159 aa, Homo Sapiens
MPVRRGHVAPQNTFLDTIIRKFEGQSRKFIIANARVENCAVIYCNDGFCELCGYSRAEVMQRPCTCDFLHGPRTQRRAAAQIAQALLGAEERKVEIAFYRKDGSCFLCLVDVVPVKNEDGAVIMFILNFEVVMEKDMVGSPAHDTNHRGPPTSWLAPGRAKTFRLKLPALLALTARESSVRSGGAGGAGAPGAVVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGKNDIFGEPLNLYARPGKSNGDVRALTYCDLHKIHRDDLLEVLDMYPEFSDHFWSSLEITFNLRDTNMIPGSPGSTELEGGFSRQRKRKLSFRRRTDKDTEQPGEVSALGPGRAGAGPSSRGRPGGPWGESPSSGPSSPESSEDEGPGRSSSPLRLVPFSSPRPPGEPPGGEPLMEDCEKSSDTCNPLSGAFSGVSNIFSFWGDSRGRQYQELPRCPAPTPSLLNIPLSSPGRRPRGDVESRLDALQRQLNRLETRLSADMATVLQLLQRQMTLVPPAYSAVTTPGPGPTSTSPLLPVSPLPTLTLDSLSQVSQFMACEELPPGAPELPQEGPTRRLSLPGQLGALTSQPLHRHGSDPGS

SEQ ID NO: 14941 - protein, 595 aa, Homo Sapiens [sequence omitted]

SEQ ID NO: 14942 - protein, 530 aa, Homo Sapiens
MDIKNSPSSLNSPSSYNCSQSILPLEHGSIYIPSSYVDSHHEYPAMTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHASNKGMEHLLNMKCKNVVPVYDLLLEMLNAHVLRGCKSSITGSECSPAEDSKSKEGSQNPQSQ

SEQ ID NO: 14943 - protein, 423 aa, Homo Sapiens
MSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKRTIQGSIEYSCPASNECEITKRRRKACQACRFTKCLRVGMLKEGVRLDRVRGGRQKYKRRPEVDPLPFPGPFPAGPLAVAGGPRKTAAPVNALVSHLLVVEPEKLYAMPDPAGPDGHLPAVATLCDLFDREIVVTISWAKSIPGFSSLSLSDQMSVLQSVWMEVLVLGVAQRSLPLQDELAFAEDLVLDEEGARAAGLGELGAALLQLVRRLQALRLEREEYVLLKALALANSDSVHIEDAEAVEQLREALHEALLEYEAGRAGPGGGAERRRAGRLLLTLPLLRQTAGKVLAHFYGVKLEGKVPMHKLFLEMLEAMMD

SEQ ID NO: 14944 - protein, 433 aa, Homo Sapiens
MSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKV

SEQ ID NO: 14945 - protein, 458 aa, Homo Sapiens
MDSVELCLPESFSLHYEEELLCRMSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPYNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKV

SEQ ID NO: 14946 - protein, 406 aa, Homo Sapiens
MESLRGYTHSDIGYRSLAVGEDIEEVNDEKLTVTSLMARGGEDEENTRSKPEYGTEAENNVGTEGSVPSDDQDREGGGGHEPEQQQEEPPLTKPEQQQEEPPLLELKQEQEEPPQTTVEGPQPAEGPQTAEGPQPPERKRRRRTAFTQFQLQELENFFDESQYPDVVARERLAARLNLTEDRVQVWFQNRRAKWKRNQRVLMLRNTATADLAHPLDMFLGGAYYAAPALDPALCVHLVPQLPRPPVLPVPPMPPRPPMVPMPPRPPIAPMPPMAPVPPGSRMAPVPPGPRMAPVPPWPPMAPVPPWPPMAPVPTGPPMAPVPPGPPMARVPPGPPMARVPPGPPMAPLPPGPPMAPLPPGPPMAPLPPGPPMAPLPPRSHVPHTGLAPVHITWAPVINSYYACPFF

SEQ ID NO: 14947 - protein, 441 aa, Homo Sapiens
MKAAVDLKPTLTIIKTEKVDLELFPSPDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGKLGGQDSFESIESYDSCDRLTQSWSSQSSFNSLQRVPSYDSFDSEDYPAALPNHKPKGTFKDYVRDRADLNKDKPVIPAAALAGYTGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 14948 - protein, 469 aa, Homo Sapiens
MNDFGIKNMDQVAPVANSYRGTLKRQPAFDTFDGSLFAVFPSLNEEQTLQEVPTGLDSISHDSANCELPLLTPCSKAVMSQALKATFSGFKKEQRRLGIPKNPWLWSEQQVCQWLLWATNEFSLVNVNLQRFGMNGQMLCNLGKERFLELAPDFVGDILWEHLEQMIKENQEKTEDQYEENSHLTSVPHWINSNTLGFGTEQAPYGMQTQNYPKGGLLDSMCPASTPSVLSSEQEFQMFPKSRLSSVSVTYCSVSQDFPGSNLNLLTNNSGTPKDHDSPENGADSFESSDSLLQSWNSQSSLLDVQRVPSFESFEDDCSQSLCLNKPTMSFKDYIQERSDPVEQGKPVIPAAVLAGFTGSGPIQLWQFLLELLSDKSCQSFISWTGDGWEFKLADPDEVARRWGKRKNKPKMNYEKLSRGLRYYYDKNIIHKTSGKRYVYRFVCDLQNLLGFTPEELHAILGVQPDTED

SEQ ID NO: 14949 - protein, 477 aa, Homo Sapiens
MDGFYDQQVPYMVTNSQRGRNCNEKPTNVRKRKFINRDLAHDSEELFQDLSQLQETWLAEAQVPDNDEQFVPDYQAESLAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 14950 - protein, 342 aa, Homo Sapiens
MDLWNWDEASPQEVPPGNKLAGLEGAKLGFCFPDLALQGDTPTATAETCWKGTSSSLASFPQLDWGSALLHPEVPWGAEPDSQALPWSGDWTDMACTAWDSWSGASQTLGPAPLGPGPIPAAGSEGAAGQNCVPVAGEATSWSRAQAAGSNTSWDCSVGPDGDTYWGSGLGGEPRTDCTISWGGPAGPDCTTSWNPGLHAGGTTSLKRYQSSALTVCSEPSPQSDRASLARCPKTNHRGPIQLWQFLLELLHDGARSSCIRWTGNSREFQLCDPKEVARLWGERKRKPGMNYEKLSRGLRYYYRRDIVRKSGGRKYTYRFGGRVPSLAYPDCAGGGRGAETQ

SEQ ID NO: 14951 - protein, 512 aa, Homo Sapiens
MKAGCSIVEKPEGGGGYQFPDWAYKTESSPGSRQIQLWHFILELLQKEEFRHVIAWQQGEYGEFVIKDPDEVARLWGRRKCKPQMNYDKLSRALRYYYNKRILHKTKGKRFTYKFNFNKLVMPNYPFINIRSSGVVPQSAPPVPTASSRFHFPPLDTHSPTNDVQPGRFSASSLTASGQESSNGTDRKTELSELEDGSAADWRRGVDPVSSRNAIGGGGIGHQKRKPDIMLPLFARPGMYPDPHSPFAVSPIPGRGGVLNVPISPALSLTPTIFSYSPSPGLSPFTSSSCFSFNPEEMKHYLHSQACSVFNYHLSPRTFPRYPGLMVPPLQCQMHPEESTQFSIKLQPPPVGRKNRERVESSEESAPVTTPTMASIPPRIKVEPASEKDPESLRQSAREKEEHTQEEGTVPSRTIEEEKGTIFARPAAPPIWPSVPISTPSGEPLEVTEDSEDRPGKEPSAPEKKEDALMPPKLRLKRRWNDDPEARELSKSGKFLWNGSGPQGLATAAADA

SEQ ID NO: 14952 - protein, 361 aa, Homo Sapiens
MHCSCLAEGIPANPGNWISGLAFPDWAYKAESSPGSRQIQLWHFILELLQKEEFRHVIAWQQGEYGEFVIKDPDEVARLWGRRKCKPQMNYDKLSRALRYYYNKRILHKTKGKRFTYKFNFSKLIVVNYPLWEVRAPPSPHLLLGAPALCRPALVPVGVQSELLHSMLFAHQAMVEQLTGQQTPRGPPETSGDKKGSSSSVYRLGSAPGPCRLGLCCHLGSVQGELPGVASFTPPLPPPLPSNWTCLSGPFLPPLPSEQQLPGAFKPDILLPGPRSLPGAWHFPGLPLLAGLGQGAGERLWLLSLRPEGLEVKPAPMMEAKGGLDPREVFCPETRRLKTGEESLTSPNLENLKAVWPLDPP

SEQ ID NO: 14953 - protein, 484 aa, Homo Sapiens
MERRMKAGYLDQQVPYTFSSKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 14954 - protein, 510 aa, Homo Sapiens
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTPLSPTHQNPLFPPPQATLPTSGHAPAAGPVQGVGPAPAPHSLPEPGPQQQTFAVPRPPHQPLQMPKMMPENQYPSEQRFQRQLSEPCHPFPPQPGVPGDNRPSYHRQMSEPIVPAAPPPPQGFKQEYHDPLYEHGVPGMPGPPAHGFQSPMGIKQEPRDYCVDSEVPNCQSSYMRGGYFSSSHEGFSYEKDPRLYFDDTCVVPERLEGKVKQEPTMYREGPPYQRRGSLQLWQFLVTLLDDPANAHFIAWTGRGMEFKLIEPEEVARRWGIQKNRPAMNYDKLSRSLRYYYEKGIMQKVAGERYVYKFVCDPDALFSMAFPDNQRPFLKAESECHLSEEDTLPLTHFEDSPAYLLDMDRCSSLPYAEGFAY

SEQ ID NO: 14955 - protein, 452 aa, Homo Sapiens
MSETPAQCSIKQERISYTPPESPVPSYASSTPLHVPVPRALRMEEDSIRLPAHLRLQPIYWSRDDVAQWLKWAENEFSLRPIDSNTFEMNGKALLLLTKEDFRYRSPHSGDVLYELLQHILKQRKPRILFSPFFHPGNSIHTQPEVILHQNHEEDNCVQRTPRPSVDNVHHNPPTIELLHRSRSPITTNHRPSPDPEQRPLRSPLDNMIRRLSPAERAQGPRPHQENNHQESYPLSVSPMENNHCPASSESHPKPSSPRQESTRVIQLMPSPIMHPLILNPRHSVDFKQSRLSEDGLHREGKPINLSHREDLAYMNHIMVSVSPPEEHAMPIGRIADCRLLWDYVYQLLSDSRYENFIRWEDKESKIFRIVDPNGLARLWGNHKNRTNMTYEKMSRALRHYYKLNIIRKEPGQRLLFRFMKTPDEIMSGRTDRLEHLESQELDEQIYQEDEC

SEQ ID NO: 14956 - protein, 341 aa, Homo Sapiens
MQEGELAISPISPVAAMPPLGTHVQARCEAQINLLGEGGICKLPGRLRIQPALWSREDVLHWLRWAEQEYSLPCTAEHGFEMNGRALCILTKDDFRHRAPSSGDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 14957 - protein, 407 aa, Homo Sapiens
MESRKDMVVFLDGGQLGTLVGKRVSNLSEAVGSPLPEPPEKMVPRGCLSPRAVPPATRERGGGGPEEEPVDGLAGSAAGPGAEPQVAGAAMLGPGPPAPSVDSLSGQGQPSSSDTESDFYEEIEVSCTPDCATGNAEYQHSKGSGSEALVGSPNGGSETPKSNGGSGGGGSQGTLACSASDQMRRYRTAFTREQIARLEKEFYRENYVSRPRRCELAAALNLPETTIKVWFQNRRMKDKRQRLAMTWPHPADPAFYTYMMSHAAAAGGLPYPFPSHLPLPYYSPVGLGAASAASAAASPFSGSLRPLDTFRVLSQPYPRPELLCAFRHPPLYPGPAHGLGASAGGPCSCLACHSGPANGLAPRAAAASDFTCASTSRSDSFLTFAPSVLSKASSVALDQREEVPLTR

SEQ ID NO: 14958 - protein, 476 aa, Homo Sapiens
MMERIRKEMILMERGLHSPTAGKRFSNLSNSAGNAVLEALENSQHPARLSPRLPSAPLHSALGELPAKGKFEIDTLFNLQHTGSESTVSSEISSAAESRKKPGHYSEAAAEADMSSDVEVGCSALRSPGGLGAAQLKENNGKGYAESGSAAGTTTSASGSGLGSLHGGSGGSGGSAALGGSGSGADQVRRYRTAFTREQIARLEKEFYRENYVSRPRRCELAAALNLPETTIKVWFQNRRMKDKRQRLAMSWPHPADPSFYTYMMTHAAATGSLPYPFHSHVPLHYYPHVGVTAAAAAAAASGAAAAASSPFATSIRPLDTFRALSHPYSRPELLCSFRHPGLYQAPAAAAGLNSAASAAAAAAAAAAAASSAAAAGAPPSGGSAPCSCLSCHSSQSAAAAAAAAAAALGSRGGGGGGGGGGGGGGGGAGAGGGSDFGCSAAAPRSESGFLPYSAAVLSKTAVSPPDQRDEAPLTR

SEQ ID NO: 14959 - protein, 747 aa, Homo Sapiens
MEIPNPPTSKCITYWKRKVKSEYMRLRQLKRLQANMGAKALYVANFAKVQEKTQILNEEWKKLRVQPVQSMKPVSGHPFLKKCTIESIFPGFASQHMLMRSLNTVALVPIMYSWSPLQQNFMVEDETVLCNIPYMGDEVKEEDETFIEELINNYDGKVHGEEEMIPGSVLISDAVFLELVDALNQYSDEEEEGHNDTSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHHIVSASCSNASASAVAETKEGDSDRDTGNDWASSSSEANSRCQTPTKQKASPAPPQLCVVEAPSEPVEWTGAEESLFRVFHGTYFNNFCSIARLLGTKTCKQVFQFAVKESLILKLPTDELMNPSQKKKRKHRLWAAHCRKIQLKKDNSSTQVYNYQPCDHPDRPCDSTCPCIMTQNFCEKFCQCNPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVL

SEQ ID NO: 14960 - protein, 746 aa, Homo Sapiens
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 14961 - protein, 330 aa, Homo Sapiens
MKRRQKRKHLENEESQETAEKGGGMSKSQEDALQPGSTRVAKGWSQGVGEVTSTSEYCSCVSSSRKLIHSGIQRIHRDSPQPQSPLAQVQERGETPPRSQHVSLSSYSSYKTCVSSLCVNKEERGMKIYYMQVQMNKGVAVSWETEETLESLEKQPRMEEVTLSEVVRVGTPPSDVSTRNLLSDSEPSGEEKEHEERTESDSLPGSPTVEDTPRAKTPDWLVTMENGFRCMACCRVFTTMEALQEHVQFGIREGFSCHVFHLTMAQLTGNMESESTQDEQEEENGNEKEEEEKPEAKEEEGQPTEEDLGLRRSWSQCPGCVFHSPKDRNS

SEQ ID NO: 14962 - protein, 166 aa, Homo Sapiens
MAAYPESCVDTTVLDFVADLSLASPRRPLLCDFAPGVSLGDPALALREGRPRRMARFEEGDPEEEECEVDQGDGEEEEEEERGRGVSLLGRPKRKRVITYAQRQAANIRERKRMFNLNEAFDQLRRKVPTFAYEKRLSRIETLRLAIVYISFMTELLESCEKKESG

SEQ ID NO: 14963 - protein, 238 aa, Homo Sapiens
MRQSGASQPLLINMYLPDPVGDGLFKDGKNPSWGPLSPAVQKGSGQIQLWQFLLELLADRANAGCIAWEGGHGEFKLTDPDEVARRWGERKSKPNMNYDKLSRALRYYYDKNIMSKVHGKRYAYRFDFQGLAQACQPPPAHAHAAAAAAAAAAAAQDGALYKLPAGLAPLPFPGLSKLNLMAASAGVAPAGFSYWPGPGPAATAAAATAALYPSPSLQPPPGPFGAVAAASHLGGHYH

SEQ ID NO: 14964 - protein, 475 aa, Homo Sapiens
MDSSCHNATTKMLATAPARGNMMSTSKPLAFSIERIMARTPEPKALPVPHFLQGALPKGEPKHSLHLNSSIPCMIPFVPVAYDTSPKAGVTGSEPRKASLEAPAAPAAVPSAPAFSCSDLLNCALSLKGDLARDALPLQQYKLVRPRVVNHSSFHAMGALCYLNRGDGPCHPAAGVNIHPVASYFLSSPLHPQPKTYLAERNKLVVPAVEKYPSGVAFKDLSQAQLQHYMKESAQLLSEKIAFKTSDFSRGSPNAKPKVFTCEVCGKVFNAHYNLTRHMPVHTGARPFVCKVCGKGFRQASTLCRHKIIHTQEKPHKCNQCGKAFNRSSTLNTHTRIHAGYKPFVCEFCGKGFHQKGNYKNHKLTHSGEKQFKCNICNKAFHQVYNLTFHMHTHNDKKPFTCPTCGKGFCRNFDLKKHVRKLHDSSLGLARTPAGEPGTEPPPPLPQQPPMTLPPLQPPLPTPGPLQPGLHQGHQ

SEQ ID NO: 14965 - protein, 459 aa, Homo Sapiens
MASSASLETMVPPACPRAGASPATSKTLAFSIERIMAKTSEPRAPFEPRPGALEADGSQGKKLLNLCSPLPCMIPLQPLGYEVPSKTLLSYSELWKSSLRAGGGGGGGGGGGGGGGGAPVCGASGLCKTNCGVCCKAELGLAPSALPAGRVIKPQVINQAVGLPASGSLYYFNYLDSTAYPPSELLSGHLFPSGLLNAQAPAALAAHPKLFLLENAKLAGLAADKFPHPAPYPHKERLPAPLEQVLKENSALTAERGGVKGHSKLPGGSADGKPKNFTCEVCGKVFNAHYNLTRHMPVHTGARPFVCKVCGKGFRQASTLCRHKIIHTQEKPHKCNQCGKAFNRSSTLNTHIRIHAGYKPFVCEFCGKGFHQKGNYKNHKLTHSGEKQYKCTICNKAFHQVYNLTFHMHTHNDKKPFTCATCGKGFCRNFDLKKHVRKLHDSVGPAAPSAKDLTRTVQS

SEQ ID NO: 14966 - protein, 219 aa, Homo Sapiens
MDPAPGVLDPRAAPPALLGTPQAEVLEDVLREQFGPLPQLAAVCRLKRLPSGGYSSTENLQLVLERRRVANAKERERIKNLNRGFARLKALVPFLPQSRKPSKVDILKGATEYIQVLSDLLEGAKDSKKQDPDEQSYSNNSSESHTSSARQLSRNITQHISCAFGLKNEEEGPWADGGSGEPAHACRHSVMSTTEIISPTRSLDRFPEVELLSHRLPQV

SEQ ID NO: 14967 - protein, 496 aa, Homo Sapiens
MDDVPAPTPAPAPPAAAAPRVPFHCSECGKSFRYRSDLRRHFARHTALKPHACPRCGKGFKHSFNLANHLRSHTGERPYRCSACPKGFRDSTGLLHHQVVHTGEKPYCCLVCELRFSSRSSLGRHLKRQHRGVLPSPLQPGPGLPALSAPCSVCCNVGPCSVCGGSGAGGGEGPEGAGAGLGSWGLAEAAAAAAASLPPFACGACARRFDHGRELAAHWAAHTDVKPFKCPRCERDFNAPALLERHKLTHDLQGPGAPPAQAWAAGPGAGPETAGEGTAAEAGDAPLASDRRLLLGPAGGGVPKLGGLLPEGGGEAPAPAAAAEPSEDTLYQCDCGTFFASAAALASHLEAHSGPATYGCGHCGALYAALAALEEHRRVSHGEGGGEEAATAAREREPASGEPPSGSGRGKKIFGCSECEKLFRSPRDLERHVLVHTGEKPFPCLECGKFFRHECYLKRHRLLHGTERPFPCHICGKGFITLSNLSRHLKLHRGMD

SEQ ID NO: 14968 - protein, 452 aa, Homo Sapiens
MDGTIKEALSVVSDDQSLFDSAYGAAAHLPKADMTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 14969 - protein, 380 aa, Homo Sapiens
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 14970 - protein, 338 aa, Homo Sapiens
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 14971 - protein, 271 aa, Homo Sapiens
MFRDFGEPGPSSGNGGGYGGPAQPPAAAQAAQQKFHLVPSINTMSGSQELQWMVQPHFLGPSSYPRPLTYPQYSPPQPRPGVIRALGPPPGVRRRPCEQISPEEEERRRVRRERNKLAAAKCRNRRKELTDFLQAETDKLEDEKSGLQREIEELQKQKERLELVLEAHRPICKIPEGAKEGDTGSTSGTSSPPAPCRPVPCISLSPGPVLEPEALHTPTLMTTPSLTPFTPSLVFTYPSTPEPCASAHRKSSSSSGDPSSDPLGSPTLLAL

SEQ ID NO: 14972 - protein, 326 aa, Homo Sapiens
MYQDYPGNFDTSSRGSSGSPAHAESYSSGGGGQQKFRVDMPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAETEELEEEKSGLQKEIAELQKEKEKLEFMLVAHGPVCKISPEERRSPPAPGLQPMRSGGGSVGAVVVKQEPLEEDSPSSSSAGLDKAQRSVIKPISIAGGFYGEEPLHTPIVVTSTPAVTPGTSNLVFTYPSVLEQESPASPSESCSKAHRRSSSSGDQSSDSLNSPTLLAL

SEQ ID NO: 14973 - protein, 472 aa, Homo Sapiens
MLGTVKMEGHETSDWNSYYADTQEAYSSVPVSNMNSGLGSMNSMNTYMTMNTMTTSGNMTPASFNMSYANPGLGAGLSPGAVAGMPGGSAGAMNSMTAAGVTAMGTALSPSGMGAMGAQQAASMNGLGPYAAAMNPCMSPMAYAPSNLGRSRAGGGGDAKTFKRSYPHAKPPYSYISLITMAIQQAPSKMLTLSEIYQWIMDLFPYYRQNQQRWQNSIRHSLSFNDCFVKVARSPDKPGKGSYWTLHPDSGNMFENGCYLRRQKRFKCEKQPGAGGGGGSGSGGSGAKGGPESRKDPSGASNPSADSPLHRGVHGKTGQLEGAPAPGPAASPQTLDHSGATATGGASELKTPASSTAPPISSGPGALASVPASHPAHGLAPHESQLHLKGDPHYSFNHPFSINNLMSSSEQQHKLDFKAYEQALQYSPYGSTLPASLPLGSASVTTRSPIEPSALEPAYYQGVYSRPVLNTS

SEQ ID NO: 14974 - protein, 457 aa, Homo Sapiens
MLGAVKMEGHEPSDWSSYYAEPEGYSSVSNMNAGLGMNGMNTYMSMSAAAMGSGSGNMSAGSMNMSSYVGAGMSPSLAGMSPGAGAMAGMGGSAGAAGVAGMGPHLSPSLSPLGGQAAGAMGGLAPYANMNSMSPMYGQAGLSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASETPAGTESPHSSASPCQEHKRGGLGELKGTPAAALSPPEPAPSPGQQQQAAAHLLGPPHHPGLPPEAHLKPEHHYAFNHPFSINNLMSSEQQHHHSHHHHQPHKMDLKAYEQVMHYPGYGSPMPGSLAMGPVTNKTGLDASPLAADTSYYQGVYSRPIMNSS

SEQ ID NO: 14975 - protein, 350 aa, Homo Sapiens
MLGSVKMEAHDLAEWSYYPEAGEVYSPVTPVPTMAPLNSYMTLNPLSSPYPPGGLPASPLPSGPLAPPAPAAPLGPTFPGLGVSGGSSSSGYGAPGPGLVHGKEMPKGYRRPLAHAKPPYSYISLITMAIQQAPGKMLTLSEIYQWIMDLFPYYRENQQRWQNSIRHSLSFNDCFVKVARSPDKPGKGSYWALHPSSGNMFENGCYLRRQKRFKLEEKVKKGGSGAATTTRNGTGSAASTTTPAATVTSPPQPPPPAPEPEAQGGEDVGALDCGSPASSTPYFTGLELPGELKLDAPYNFNHPFSINNLMSEQTPAPPKLDVGFGGYGAEGGEPGVYYQGLYSRSLLNAS

SEQ ID NO: 14976 - protein, 325 aa, Homo Sapiens
MPRPGRNTYSDQKPPYSYISLTAMAIQSSPEKMLPLSEIYKFIMDRFPYYRENTQRWQNSLRHNLSFNDCFIKIPRRPDQPGKGSFWALHPSCGDMFENGSFLRRRKRFKVLKSDHLAPSKPADAAQYLQQQAKLRLSALAASGTHLPQMPAAAYNLGGVAQPSGFKHPFAIENIIAREYKMPGGLAFSAMQPVPAAYPLPNQLTTMGSSLGTGWPHVYGSAGMIDSATPISMASGDYSAYGVPLKPLCHAAGQTLPAIPVPIKPTPAAVPALPALPAPIPTLLSNSPPSLSPTSSQTATSQSSPATPSETLTSPASALHSVAVH

SEQ ID NO: 14977 - protein, 432 aa, Homo Sapiens
MPRPGKSSYSDQKPPYSYISLTAMAIQHSAEKMLPLSDIYKFIMERFPYYREHTQRWQNSLRHNLSFNDCFIKIPRRPDQPGKGSFWALHPDCGDMFENGSFLRRRKRFKVLRADHTHLHAGSTKSAPGAGPGGHLHPHHHHHPHHHHHHHAAAHHHHHHHPPQPPPPPPPPPPHMVHYFHQQPPTAPQPPPHLPSQPPQQPPQQSQPQQPSHPGKMQEAAAVAAAAAAAAAAAVGSVGRLSQFPPYGLGSAAAAAAAAAASTSGFKHPFAIENIIGRDYKGVLQAGGLPLASVMHHLGYPVPGQLGNVVSSVWPHVGVMDSVAAAAAAAAAAGVPVGPEYGAFGVPVKSLCHSASQSLPAMPVPIKPTPALPPVSALQPGLTVPAASQQPPAPSTVCSAAAASPVASLLEPTAPTSAESKGGSLHSVLVHS

SEQ ID NO: 14978 - protein, 553 aa, Homo Sapiens
MQARYSVSSPNSLGVVPYLGGEQSYYRAAAAAAGGGYTAMPAPMSVYSHPAHAEQYPGGMARAYGPYTPQPQPKDMVKPPYSYIALITMAIQNAPDKKITLNGIYQFIMDRFPFYRDNKQGWQNSIRHNLSLNECFVKVPRDDKKPGKGSYWTLDPDSYNMFENGSFLRRRRRFKKKDAVKDKEEKDRLHLKEPPPPGRQPPPAPPEQADGNAPGPQPPPVRIQDIKTENGTCPSPPQPLSPAAALGSGSAAAVPKIESPDSSSSSLSSGSSPPGSLPSARPLSLDGADSAPPPPAPSAPPPHHSQGFSVDNIMTSLRGSPQSAAAELSSGLLASAAASSRAGIAPPLALGAYSPGQSSLYSSPCSQTSSAGSSGGGGGGAGAAGGAGGAGTYHCNLQAMSLYAAGERGGHLQGAPGGAGGSAVDDPLPDYSLPPVTSSSSSSLSHGGGGGGGGGGQEAGHHPAAHQGRLTSWYLNQAGGDLGHLASAAAAAAAAGYPGQQQNFHSVREMFESQRIGLNNSPVNGNSSCQMAFPSSQSLYRTSGAFVYDCSKF

SEQ ID NO: 14979 - protein, 501 aa, Homo Sapiens
MQARYSVSDPNALGVVPYLSEQNYYRAAGSYGGMASPMGVYSGHPEQYSAGMGRSYAPYHHHQPAAPKDLVKPPYSYIALITMAIQNAPEKKITLNGIYQFIMDRFPFYRENKQGWQNSIRHNLSLNECFVKVPRDDKKPGKGSYWTLDPDSYNMFENGSFLRRRRRFKKKDVSKEKEERAHLKEPPPAASKGAPATPHLADAPKEAEKKVVIKSEAASPALPVITKVETLSPESALQGSPRSAASTPAGSPDGSLPEHHAAAPNGLPGFSVENIMTLRTSPPGGELSPGAGRAGLVVPPLALPYAAAPPAAYGQPCAQGLEAGAAGGYQCSMRAMSLYTGAERPAHMCVPPALDEALSDHPSGPTSPLSALNLAAGQEGALAATGHHHQHHGHHHPQAPPPPPAPQPQPTPQPGAAAAQAASWYLNHSGDLNHLPGHTFAAQQQTFPNVREMFNSHRLGIENSTLGESQVSGNASCQLPYRSTPPLYRHAAPYSYDCTKY

SEQ ID NO: 14980 - protein, 465 aa, Homo Sapiens
MTLSTEMSDASGLAEETDIDVVGEGEDEEDEEEEDDDEGGGGGPRLAVPAQRRRRRRSYAGEDELEDLEEEEDDDDILLAPPAGGSPAPPGPAPAAGAGAGGGGGGGGAGGGGSAGSGAKNPLVKPPYSYIALITMAILQSPKKRLTLSEICEFISGRFPYYREKFPAWQNSIRHNLSLNDCFVKIPREPGNPGKGNYWTLDPESADMFDNGSFLRRRKRFKRQPLLPPNAAAAESLLLRGAGAAGGAGDPAAAAALFPPAPPPPPHAYGYGPYGCGYGLQLPPYAPPSALFAAAAAAAAAAAFHPHSPPPPPPPHGAAAELARTAFGYRPHPLGAALPGPLPASAAKAGGPGASALARSPFSIESIIGGSLGPAAAAAAAAQAAAAAQASPSPSPVAAPPAPGSSGGGCAAQAAVGPAAALTRSLVAAAAAAASSVSSSAALGTLHQGTALSSVENFTARISNC

SEQ ID NO: 14981 - protein, 495 aa, Homo Sapiens
MTLGSCCCEIMSSESSPAALSEADADIDVVGGGSGGGELPARSGPRAPRDVLPHGHEPPAEEAEADLAEDEEESGGCSDGEPRALASRGAAAAAGSPGPGAAAARGAAGPGPGPPSGGAATRSPLVKPPYSYIALITMAILQSPKKRLTLSEICEFISGRFPYYREKFPAWQNSIRHNLSLNDCFVKIPREPGNPGKGNYWTLDPESADMFDNGSFLRRRKRFKRQPLPPPHPHPHPHPELLLRGGAAAAGDPGAFLPGFAAYGAYGYGYGLALPAYGAPPPGPAPHPHPHPHAFAFAAAAAAAPCQLSVPPGRAAAPPPGPPTASVFAGAGSAPAPAPASGSGPGPGPAGLPAFLGAELGCAKAFYAASLSPPAAGTAAGLPTALLRQGLKTDAGGGAGGGGAGAGQRPSFSIDHIMGHGGGGAAPPGAGEGSPGPPFAAAAGPGGQAQVLAMLTAPALAPVAGHIRLSHPGDALLSSGSRFASKVAGLSGCHF

SEQ ID NO: 14982 - protein, 478 aa, Homo Sapiens
MTLSGGGSASDMSGQTVLTAEDVDIDVVGEGDDGLEEKDSDAGCDSPAGPPELRLDEADEVPPAAPHHGQPQPPHQQPLTLPKEAAGAGAGPGGDVGAPEADGCKGGVGGEEGGASGGGPGAGSGSAGGLAPSKPKNSLVKPPYSYIALITMAILQSPQKKLTLSGICEFISNRFPYYREKFPAWQNSIRHNLSLNDCFVKIPREPGNPGKGNYWTLDPQSEDMFDNGSFLRRRKRFKRHQQEHLREQTALMMQSFGAYSLAAAAGAAGPYGRPYGLHPAAAAGAYSHPAAAAAAAAAAALQYPYALPPVAPVLPPAVPLLPSGELGRKAAAFGSQLGPGLQLQLNSLGAAAAAAGTAGAAGTTASLIKSEPSARPSFSIENIIGGGPAAPGGSAVGAGVAGGTGGSGGGSTAQSFLRPPGTVQSAALMATHQPLSLSRTTATIAPILSVPLSGQFLQPAASAAAAAAAAAQAKWPAQ

SEQ ID NO: 14983 - protein, 439 aa, Homo Sapiens
MNLPRAERLRSTPQRSLRDSDGEDGKIDVLGEEEDEDEEEAASQQFLEQSLQPGLQVARWGGVALPREHIEGGGGPSDPSEFGTEFRAPPRSAAASEDARQPAKPPSSYIALITMAILQSPHKRLTLSGICAFISDRFPYYRRKFPAWQNSIRHNLSLNDCFVKIPREPGRPGKGNYWSLDPASQDMFDNGSFLRRRKRFQRHQPTPGAHLPHPFPLPAAHAALHNPRPGPLLGAPAPPQPVPGAYPNTGPGRRPYALLHPHPPRYLLLSAPAYAGAPKKAEGADLATPAPFPCCSPHLVLSLGRRARVWRRHREADASLSALRVSCKGSGERVQGLRRVCPRPRGATAPCSSDRQACRTILQQQQRHQEEDCANGCAPTKGAVLGGHLSAASALLRYQAVAEGSGLTSLAAPLGGEGTSPVFLVSPTPSSLAESAGPS

SEQ ID NO: 14984 - protein, 408 aa, Homo Sapiens
MNLPRAERPRSTPQRSLRDSDGEDGKIDVLGEEEDEDEVEDEEEEASQKFLEQSLQPGLQVARWGGVALPREHIEGGGPSDPSEFGTEFRAPPRSAAASEDARQPAKPPYSYIALITMAILQSPHKRLTLSGICAFISGRFPYYRRKFPAWQNSIRHNLSLNDCFVKIPREPGHPGKGTYWSLDPASQDMFDNGSFLRRRKRFKRHQLTPGAHLPHPFPLPAAHAALHNPRPGPLLGAPALPQPVPGAYPNTAPGRRPYALLHPHPPRYLLLSAPAYAGAPKKAEGADLATPGTLPVLQPSLGPQPWEEGKGLASPPGGGCISFSIESIMQGVRGAGTGAAQSLSPTAWSYCPLLQRPSSLSDNFAATAAASGGGLRQRLRSHQGRGAGRAPVGRVGAAAVSGGGRGL

SEQ ID NO: 14985 - protein, 417 aa, Homo Sapiens
MNLPRAERLRSTPQRSLRDSDGEDGKIDVLGEEEDEDEVEDEEEAASQQFLEQSLQPGLQVARWGGVALPREHIEGGGGPSDPSEFGTKFRAPPRSAAASEDARQPAKPPYSYIALITMAILQNPHKRLTLSGICAFISGRFPYYRRKFPAWQNSIRHNLSLNDCFVKIPREPGHPGKGNYWSLDPASQDMFDNGSFLRRRKRFKRHQLTPGAHLPHPFPLPAAHAALHNPRPGPLLGAPAPPQPVPGAYPNTAPGRRPYALLHPHPLRYLLLSAPVYAGAPKKAEGAALATPAPFPCCSPHLVLSLGRRARVWRRHREADASLSALRVLCKGSGERVQGLRRICPRPRGATATCSSDHQACCIPRPLPLCCKCPPPPLLGQFCSNSSSIRRRTAPTAALPPRARCWAGTCRPRRPC

SEQ ID NO: 14986 - protein, 416 aa, Homo Sapiens
MNLPRAERPRSTPQRSLRDSDGEDGKIDVLGEEEDEDEVEDEEEEARQQFLEQSLQPGLQVARWGGVALPREHIEGGGGPSDPSEFGTKFRAPPRSAAASEDARQPAKPPYSYIALITMAILQNPHKRLTLSGICAFISGRFPYYRRKFPAWQNSIRHNLSLNDCFVKIPREPGHPGKGNYWSLDPASQDMFDNGSFLRRRKRFKRHQLTPGAHLPHPFPLPAAHAALHNPHPGPLLGAPAPPQPVPGAYPNTAPGRRPYALLHPHPLRYLLLSARVYAGAPKKAEGADLATPAPFPCCSPHLVLSLGRRARVWRRHREADASLSALRVLCKGSGERVQGLRRVCPRPRGATATCSSDHQACCIPKPLPLCCKCPPPLLLGQFCSNSSSIRRTAPTAALPPRARCWAGTCRPRRRC

SEQ ID NO: 14987 - protein, 416 aa, Homo Sapiens
MNLPRAERPRSTPQRSLRDSDGEDGKIDVLGEEEDEDEVEDEEEEARQQFLEQSLQPGLQVARWGGVALPREHIEGGGGPSDPSEFGTKFRAPPRSAAASEDARQPAKPPYSYIALITMAILQNPHKRLTLSGICAFISGRFPYYRRKFPAWQNSIRHNLSLNDCFVKIPREPGHPGKGNYWSLDPASQDMFDNGSFLRRRKRFKRHQLTPGAHLPHPFPLPAAHAALHNPHPGPLLGAPAPPQPVPGAYPNTAPGRCPYALLHPHPLRYLLLSAPVYAGAPKKAEGADLATPAPFPCCSPHLVLSLGRRARVWRRHREADASLSALRVLCKGSGERVQGLRRVCPRPRGATATCSSDHQACCIPKPLPLCCKCPPPLLLGQFCSNSSSIRRTAPTAALPPRARCWAGTCRPRRRC

SEQ ID NO: 14988 - protein, 417 aa, Homo Sapiens
MNLPRAERLRSTPQRSLRDSDGEDGKIDVLGEEEDEDEVEDEEEAASQQFLEQSLQPGLQVARWGGVALPREHIEGGGGPSDPSEFGTKFRAPPRSAAASEDARQPAKPPYSYIALITMAILQNPHKRLTLSGICAFISGRFPYYRRKFPAWQNSIRHNLSLNDCFVKIPREPGHPGKGNYWSLDPASQDMFDNGSFLRRRKRFKRHQLTPGAHLPHPFPLPAAHAALHNPHPGPLLGAPAPPQPVPGAYPNTAPGRRPYALLHPHPLRYLLLSAPVYAGAPKKAEGAALATPAPFPCCSPHLVLSLGRRARVWRRHREADASLSALRVLCKGSGERVQGLRRVCPRPRGATATCSSDHQACCIPRPLPLCCKCPPPPLLGQFCSNSSSIRRRTAPTAALPPRARCWAGTCRPRRPC

SEQ ID NO: 14989 - protein, 373 aa, Homo Sapiens
MTAESGPPPPQPEVLATVKEERGETAAGAGVPGEATGRGAGGRRRKRPLQRGKPPYSYIALIAMAIAHAPERRLTLGGIYKFITERFPFYRDNPKKWQNSIRHNLTLNDCFLKIPREAGRPGKGNYWALDPNAEDMFESGSFLRRRKRFKRSDLSTYPAYMHDAAAAAAAAAAAAAAAAIFPGAVPAARPPYPGAVYAGYAPPSLAAPPPVYYPAASPGPCRVFGLVPERPLSPELGPAPSGPGGSCAFASAGAPATTTGYQPAGCTGARPANPSAYAAAYAGPDGAYPQGAGSAIFAAAGRLAGPASPPAGGSSGGVETTVDFYGRTSPGQFGALGACYNPGGQLGGASAGAYHARHAAAYPGGIDRFVSAM

SEQ ID NO: 14990 - protein, 319 aa, Homo Sapiens
MAGRSDMDPPAAFSGFPALPAVAPSGPPPSPLAGAEPGREPEEAAAGRGEAAPTPAPGPGRRRRRPLQRGKPPYSYIALIAMALAHAPGRRLTLAAIYRFITERFAFYRDSPRKWQNSIRHNLTLNDCFVKVPREPGNPGKGNYWTLDPAAADMFDNGSFLRRRKRFKRAELPAHAAAAPGPPLPFPYAPYAPAPGPALLVPPPSAGPGPSPPARLFSVDSLVNLQPELAGLGAPEPPCCAAPDAAAAAFPPCAAAASPPLYSQVPDRLVLPATRPGPGPLPAEPLLALAGPAAALGPLSPGEAYLRQPGFASGLERYL

SEQ ID NO: 14991 - protein, 379 aa, Homo Sapiens
MSSAPEKQQPPHGGGGGGGGGGGAAMDPASSGPSKAKKTNAGIRRPEKPPYSYIALIVMAIQSSPTKRLTLSEIYQFLQSRFPFFRGSYQGWKNSVRHNLSLNECFIKLPKGLGRPGKGHYWTIDPASEFMFEEGSFRRRPRGFRRKCQALKPMYSMMNGLGFNHLPDTYGFQGSAGGLSCPPNSLALEGGLGMMNGHLPGNVDGMALPSHSVPHLPSNGGHSYMGGCGGAAAGEYPHHDSSVPASPLLPTGAGGVMEPHAVYSGSAAAWPPSASAALNSGASYIKQQPLSPCNPAANPLSGSLSTHSLEQPYLHQNSHNAPAELQGIPRYHSQSPSMCDRKEFVFSFNAMASSSMHSAGGGSYYHQQVTYQDIKPCVM

SEQ ID NO: 14992 - protein, 444 aa, Homo Sapiens
MTTEGGPPPAPLRRACSPVPGALQAALMSPPPAAAAAAAAAPETTSSSSSSSSASCASSSSSSNSASAPSAACKSAGGGGAGAGSGGAKKASSGLRRPEKPPYSYIALIVMAIQSSPSKRLTLSEIYQFLQARFPFFRGAYQGWKNSVRHNLSLNECFIKLPKGLGRPGKGHYWTIDPASEFMFEEGSFRRRPRGFRRKCQALKPMYHRVVSGLGFGASLLPQGFDFQAPPSAPLGCHSQGGYGGLDMMPAGYDAGAGAPSHAHPHHHHHHHVPHMSPNPGSTYMASCPVPAGPGGVGAAGGGGGGDYGPDSSSSPVPSSPAMASAIECHSPYTSPAAHWSSPGASPYLKQPPALTPSSNPAASAGLHSSMSSYSLEQSYLHQNAREDLSVGLPRYQHHSTPVCDRKDFVLNFNGISSFHPSASGSYYHHHHQSVCQDIKPCVM

SEQ ID NO: 14993 - protein, 489 aa, Homo Sapiens [sequence omitted]

SEQ ID NO: 14994 - protein, 365 aa, Homo Sapiens
MGPCSGSRLGPPEAESPSQPPKRRKKRYLRHDKPPYTYLAMIALVIQAAPSRRLKLAQIIRQVQAVFPFFREDYEGWKDSIRHNLSSNRCFRKVPKDPAKPQAKGNFWAVDVSLIPAEALRLQNTALCRRWQNGGARGAFAKDLGPYVLHGRPYRPPSPPPPPSEGFSIKSLLGGSGEGAPWPGLAPQSSPVPAGTGNSGEEAVPTPPLPSSERPLWPLCPLPGPTRVEGETVQGGAIGPSTLSPEPRAWPLHLLQGTAVPGGRSSGGHRASLWGQLPTSYLPIYTPNVVMPLAPPPTSCPQCPSTSPAYWGVAPETRGPPGLLCDLDALFQGVPPNKSIYDVWVSHPRDLAAPGPGWLLSWCSL

SEQ ID NO: 14995 - protein, 378 aa, Homo Sapiens
MSSFDLPAPSPPRCSPQFPSIGQEPPEMNLYYENFFHPQGVPSPQRPSFEGGGEYGATPNPYLWFNGPTMTPPPYLPGPNASPFLPQAYGVQRPLLPSVSGLGGSDLGWLPIPSQEELMKLVRPPYSYSALIAMAIHGAPDKRLTLSQIYQYVADNFPFYNKSKAGWQNSIRHNLSLNDCFKKVPRDEDDPGKGNYWTLDPNCEKMFDNGNFRRKRKRKSDVSSSTASLALEKTESSLPVDSPKTTEPQDILDGASPGGTTSSPEKRPSPPPSGAPCLNSFLSSMTAYVSGGSPTSHPLVTPGLSPEPSDKTGQNSLTFNSFSPLTNLSNHSGGGDWANPMPTNMLSYGGSVLSQFSPHFYNSVNTSGVLYPREGTEV

SEQ ID NO: 14996 - protein, 318 aa, Homo Sapiens
MATYCDDLGPSSAPPGQAQATAHPPGYEPGDLGAVGGGPLLWVNAPALSPKSYASGPGPAPPYAAPSYGAPGPLLGAPGGLAGADLAWLSLSGQQELLRLVRPPYSYSALIAMAIQSAPLRKLTLSQIYQYVAGNFPFYKRSKAGWQNSIRHNLSLNDCFKKVPRDEDDPGKGNYWTLDPNCEKMFDNGNFRRKRKRRAEASAAVRSGARSVGGAEAPALEPPSAACLDLQASPSPSAPEAATCFSGFASAMSALAGGLGTFPGGLAGDFSFGRRPPTVATHAPQTLNPSPGFAPGHQTAAAGFRLSHLLYSREGTEV

SEQ ID NO: 14997 - protein, 420 aa, Homo Sapiens
MALYCGDNFGVYSQPGLPPPAATAAAPGAPPAARAPYGLADYAAPPAAAANPYLWLNGPGVGGPPSAAAAAAAAYLGAPPPPPPPGAAAGPFLQPPPAAGTFGCSQRPFAQPAPAAPASPAAPAGPGELGWLSMASREDLMKMVRPPYSYSALIAMAIQSAPERKLTLSHIYQFVADSFPFYQRSKAGWQNSIRHNLSLNDCFKKVPRDEDDPGKGNYWTLDPNCEKMFDNGNFRRKRKRRSEASNGSTVAAGTSKSEEGLSSGLGSGVGGKPEEESPSTLLRPSHSPEPPEGTKSTASSPGGPMLTSTPCLNTFFSSLSSLSVSSSVSTQRALPGSRHLGIQGAQLPSSGVFSPTSISEASADTLQLSNSTSNSTGQRSSYYSPFPASTSGGQSSPFSSPFHNFSMVNSLIYPREGSEV

SEQ ID NO: 14998 - protein, 421 aa, Homo Sapiens
MAESWLRLSGAGPAEEAGPEGGLEEPDALDDSLTSLQWLQEFSILNAKAPALPPGGTDPHGYHQVPGSAAPGSPLAADPACLGQPHTPGKPTSSCTSRSAPPGLQAPPPDDVDYATNPHVKPPYSYATLICMAMQASKATKITLSAIYKWITDNFCYFRHADPTWQNSIRHNLSLNKCFIKVPREKDEPGKGGFWRIDPQYAERLLSGAFKKRRLPPVHIHPAFARQAAQEPSAVPRAGPLTVNTEAQQLLREFEEATGEAGWGAGEGRLGHKRKQPLPKRVAKVPRPPSTLLPTPEEQGELEPLKGNFDWEAIFDAGTLGGELGALEALELSPPLSPASHVDVDLTIHGRHIDCPATWGPSVEQAADSLDFDETFLATSFLQHPWDESGSGCLPPEPLFEAGDATLASDLQDWASVGAFL

SEQ ID NO: 14999 - protein, 574 aa, Homo Sapiens
MASDLESSLTSIDWLPQLTLRATIEKLGSASQAGPPGSSRKCSPGSPTDPNATLSKDEAAVHQDGKPRYSYATLITYAINSSPAKKMTLSEIYRWICDNFPYYKNAGIGWKNSIRHNLSLNKCFRKVPRPRDDPGKGSYWTIDTCPDISRKRRHPPDDDLSQDSPEQEASKSPRGGVAGSGEASLPPEGNPQMSLQSPTSIASYSQGTGSVDGGAVAAGASGRESAEGPPPLYNTNHDFKFSYSEINFQDLSWSFRNLYKSMLEKSSSSSQHGFSSLLGDIPPSNNYYMYQQQQPPPPQQQQQQQQPPQPPPQQSQPQQQQAPAQGPSAVGGAPPLHTPSTDGCTPPGGKQAGAEGYGPPPVMAMHPPPLQHGGYHPHQHHPHSHPAQQPPPPQPQAQGQAPINNTGFAFPSDWCSNIDSLKESFKMVNRLNWSSIEQSQFSELMESLRQAEQKNWTLDQHHIANLCDSLNHFLTQTGHVPPQGGTHRPPAPARIADSCALTSGKQESAMSQVNSYGHPQAPHLYPGPSPMYPIPTQDSAGYNRPAHHMVPRPSVPPPGANEEIPDDFDWDLIT

SEQ ID NO: 15000 - protein, 622 aa, Homo Sapiens
MGLYGQACPSVTSLRMTSELESSLTSMDWLPQLTMRAAIQKSDATQNAHGTGISKKNALLDPNTTLDQEEVQQHKDGKPPYSYASLITFAINSSPKKKMTLSEIYQWICDNFPYYREAGSGWKNSIRHNLSLNKCFLKVPRSKDDPGKGSYWAIDTNPKEDVLPTRPKKRARSVERASTPYSIDSDSLGMECIISGSASPTLAINTVTNKVTLYNTDQDGSDSPRSSLNNSLSDQSLASVNLNSVGSVHSYTPVTSHPESVSQSLTPQQQPQYNLPERDKQLLFSEYNFEDLSASFRSLYKSVFEQSLSQQGLMNIPSESSQQSHTSCTYQHSPSSTVSTHPHSNQSSLSNSHGSGLNTTGSNSVAQVSLSHPQMHTQPSPHPPHRPHGLPQHPQRSPHPAPHPQQHSQLQSPHPQHPSPHQHIQHHPNHQHQTLTHQAPPPPQQVSCNSGVSNDWYATLDMLKESCRIASSVNWSDVDLSQFQGLMESMRQADLKNWSLDQVQFADLCSSLNQFFTQTGLIHSQSNVQQNVCHGAMHPTKPSQHIGTGNLYIDSRQNLPPSVMPPPGYPHIPQALSTPGTTMAGHHRAMNQQHMMPSQAFQMRRSLPPDDIQDDFDWDSIV

SEQ ID NO: 15001 - protein, 733 aa, Homo Sapiens
MAEVGEDSGARALLALRSAPCSPVLCAAAAAAAFPAAAPPPAPAQPQPPPGPPPPPPPPLPPGAIAGAGSSGGSSGVSGDSAVAGAAPALVAAAAASVRQSPGPALARLEGREFEFLMRQPSVTIGRNSSQGSVDLSMGLSSFISRRHLQLSFQEPHFYLRCLGKNGVFVDGAFQRRGAPALQLPKQCTFRFPSTAIKIQFTSLYHKEEAPASPLRPLYPQISPLKIHIPEPDLRSMVSPVPSPTGTISVPNSCPASPRGAGSSSYRFVQNVTSDLQLAAEFAAKAASEQQADTSGGDSPKDESKPPFSYAQLIVQAISSAQDRQLTLSGIYAHITKHYPYYRTADKGWQNSIRHNLSLNRYFIKVPRSQEEPGKGSFWRIDPASEAKLVEQAFRKRRQRGVSCFRTPFGPLSSRSAPASPTHPGLMSPRSGGLQTPECLSREGSPIPHDPEFGSKLASVPEYRYSQSAPGSPVSAQPVIMAVPPRPSSLVAKPVAYMPASIVTSQQPAGHAIHVVQQAPTVTMVRVVTTSANSANGYILTSQGAAGGSHDAAGAAVLDLGSEARGLEEKPTIAFATIPAAGGVIQTVASQMAPGVPGHTVTILQPATPVTLGQHHLPVRAVTQNGKHAVPTNSLAGNAYALTSPLQLLATQASSSAPVVVTRVCEVGPKEPAAAVAATATTTPATATTASASASSTGEPEVKRSRVEEPSGAVTTPAGVIAAAGPQGPGTGE

SEQ ID NO: 15002 - protein, 660 aa, Homo Sapiens
MAAAAAALSGAGTPPAGGGAGGGGAGGGGSPPGGWAVARLEGREFEYLMKKRSVTIGRNSSQGSVDVSMGHSSFISRRHLEIFTPPGGGGHGGAAPELPPAQPRPDAGGDFYLRCLGKNGVFVDGVFQRRGAPPLQLPRVCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAPANTYTVSGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNAAASPLHMLATHASASASLPTKRHNGDQPEQPELKRIKTEDGEGIVIALSVDTPPAAVREKGVQN

SEQ ID NO: 15003 - protein, 345 aa, Homo Sapiens
MSHLFDPRLPALAASPMLYLYGPERPGLPLAFAPAAALAASGRAETPQKPPYSYIALIAMAIQDAPEQRVTLNGIYQFIMDRFPFYHDNRQGWQNSIRHNLSLNDCFVKVPREKGRPGKGSYWTLDPRCLDMFENGNYRRRKRKPKPGPGAPEAKRPRAETHQRSAEAQPEAGSGAGGSGPAISRLQAAPAGPSPLLDGPSPPAPLHWPGTASPNEDAGDAAQGAAAVAVGQAARTGDGPGSPLRPASRSSPKSSDKSKSFSIDSILAGKQGQKPPSGDELLGGAKPGPGGRLGASLLAASSSLRPPFNASLMLDPHVQGGFYQLGIPFLSYFPLQVPDTVLHFQ

SEQ ID NO: 15004 - protein, 376 aa, Homo Sapiens
MMASYPEPEDAAGALLAPETGRTVKEPEGPPPSPGKGGGGGGGTAPEKPDPAQKPPYSYVALIAMAIRESAEKRLTLSGIYQYIIAKFPFYEKNKKGWQNSIRHNLSLNECFIKVPREGGGERKGNYWTLDPACEDMFEKGNYRRRRRMKRPFRPPPAHFQPGKGLFGAGGAAGGCGVAGAGADGYGYLAPPKYLQSGFLNNSWPLPQPPSPMPYASCQMAAAAAAAAAAAAAAGPGSPGAAAVVKGLAGPAASYGPYTRVQSMALPPGVVNSYNGLGGPPAAPPPPPHPHPHPHAHHLHAAAAPPPAPPHHGAAAPPPGQLSPASPATAAPPAPAPTSAPGLQFACARQPELAMMHCSYWDHDSKTGALHSRLDL

SEQ ID NO: 15005 - protein, 763 aa, Homo Sapiens
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKPLDPGSPQLPEHLESQQKRPNPELRRNMTIKTELPLGARRKMKPLLPRVSSYLVPIQFPVNQSLVLQPSVKVPLPLAASLMSSELARHSKRVRIAPKVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 15006 - protein, 648 aa, Homo Sapiens
MVSLPPPQSDVTLPGPTRLEGERQGDLMQAPGLPGSPAPQSKHAGFSCSSFVSDGPPERTPSLPPHSPRIASPGPEQVQGHCPAGPGPGPFRLSPSDKYPGFGFEEAAASSPGRFLKGSHAPFHPYKRPFHEDVFPEAETTLALKGHSFKTPGPLEAFEEIPVDVAEAEAFLPGFSAEAWCNGLPYPSQEHGPQVLGSEVKVKPPVLESGAGMFCYQPPLQHMYCSSQPPFHQYSPGGGSYPIPYLGSSHYQYQRMAPQASTDGHQPLFPKPIYSYSILIFMALKNSKTGSLPVSEIYNFMTEHFPYFKTAPDGWKNSVRHNLSLNKCFEKVENKSGSSSRKGCLWALNPAKIDKMQEELQKWKRKDPIAVRKSMAKPEELDSLIGDKREKLGSPLLGCPPPGLSGSGPIRPLAPPAGLSPPLHSLHPAPGPIPGKNPLQDLLMGHTPSCYGQTYLHLSPGLAPPGPPQPLFPQPDGHLELRAQPGTPQDSPLPAHTPPSHSAKLLAEPSPARTMHDTLLPDGDLGTDLDAINPSLTDFDFQGNLWEQLKDDSLALDPLVLVTSSPTSSSMPPPQPPPHCFPPGPCLTETGSGAGDLAAPGSGGSGALGDLHLTTLYSAFMELEPTPPTAPAGPSVYLSPSSKPVALA

SEQ ID NO: 15007 - protein, 431 aa, Homo Sapiens
MGPVIGMTPDKRAETPGAEKIAGLSQIYKMGSLPEAVDAARPKATLVDSESADDELTNLNWLHESTNLLTNFSLGSEGLPIVSPLYDIEGDDVPSFGPACYQNPEKKSATSKPPYSFSLLIYMAIEHSPNKCLPVKEIYSWILDHFPYFATAPTGWKNSVRHNLSLNKCFQKVERSHGKVNGKGSLWCVDPEYKPNLIQALKKQPFSSASSQNGSLSPHYLSSVIKQNQVRNLKESDIDAAAAMMLLNTSIEQGILECEKPLPLKTALQKKRSYGNAFHHPSAVRLQESDSLATSIDPKEDHNYSASSMAAQRCASRSSVSSLSSVDEVYEFIPKNSHVGSDGSEGFHSEEDTDVDYEDDPLGDSGYASQPCAKISEKGQSGKKMRKQTCQEIDEELKEAAGSLLHLAGIRTCLGSLISTAKTQNQKQRKK

SEQ ID NO: 15008 - protein, 490 aa, Homo Sapiens
MGPVMPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPYHPHPHVFNTPPTCPQAYQSTSGPPIWPGSTFFKRNGALLQDPDIDAASAMMLLNTPPEIQAGFPPGVIQNGARVLSRGLFPGVRPLPITPIGVTAAMRNGITSCRMRTESEPSCGSPVVSGDPKEDHNYSSAKSSNARSTSPTSDSISSSSSSADDHYEFATKGSQEGSEGSEGSFRSHESPSDTEEDDRKHSQKEPKDSLGDSGYASQHKKRQHFAKARKVPSDTLPLKKRRTEKPPESDDEEMKEAAGSLLHLAGIRSCLNNITNRTAKGQKEQKETTKN

SEQ ID NO: 15009 - protein, 517 aa, Homo Sapiens
MIESDTSSIMSGIIRNSGQNHHPSPQEYRLLATTSDDDLPGDLQSLSWLTAVDVPRLQQMASGRVDLGGPCVPHPHPGALAGVADLHVGATPSPLLHGPAGMAPRGMPGLGPITGHRDSMSQFPVGGQPSSGLQDPPHLYSPATQPQFPLPPGAQQCPPVGLYGPPFGVRPPYPQPHVAVHSSQELHPKHYPKPIYSYSCLIAMALKNSKTGSLPVSEIYSFMKEHFPYFKTAPDGWKNSVRHNLSLNKCFEKVENKMSGSSRKGCLWALNLARIDKMEEEMHKWKRKDLAAIHRSMANPEELDKLISDRPESCRRPGKPGEPEAPVLTHATTVAVAHGCLAVSQLPPQPLMTLSLQSVPLHHQVQPQAHLAPDSPAPAQTPPLHALPDLSPSPLPHPAMGRAPVDFINISTDMNTEVDALDPSIMDFALQGNLWEEMKDEGFSLDTLGAFADSPLGCDLGASGLTPASGGSDQSFPDLQVTGLYTAYSTPDSVAASGTSSSSQYLGAQGNKPIALL

SEQ ID NO: 15010 - protein, 655 aa, Homo Sapiens
MAEAPQVVEIDPDFEPLPRPRSCTWPLPRPEFSQSNSATSSPAPSGSAAANPDAAAGLPSASAAAVSADFMSNLSLLEESEDFPQAPGSVAAAVAAAAAAAATGGLCGDFQGPEAGCLHPAPPQPPPPGPLSQHPPVPPAAAGPLAGQPRKSSSSRRNAWGNLSYADLITKAIESSAEKRLTLSQIYEWMVKSVPYFKDKGDSNSSAGWKNSIRHNLSLHSKFIRVQNEGTGKSSWWMLNPEGGKSGKSPRRRAASMDNNSKFAKSRSRAAKKKASLQSGQEGAGDSPGSQFSKWPASPGSHSNDDFDNWSTFRPRTSSNASTISGRLSPIMTEQDDLGEGDVHSMVYPPSAAKMASTLPSLSEISNPENMENLLDNLNLLSSPTSLTVSTQSSPGTMMQQTPCYSFAPPNTSLNSPSPNYQKYTYGQSSMSPLPQMPIQTLQDNKSSYGGMSQYNCAPGLLKELLTSDSPPHNDIMTPVDPGVAQPNSRVLGQNVMMGPNSVMSTYGSQASHNKMMNPSSHTHPGHAQQTSAVNGRPLPHTVSTMPHTSGMNRLTQVKTPVQVPLPHPMQMSALGGYSSVSSCNGYGRMGLLHQEKLPSDLDGMFIERLDCDMESIIRNDLMDGDTLDFNFDNVLPNQSFPHSVKTTTHSWVSG

SEQ ID NO: 15011 - protein, 673 aa, Homo Sapiens
MAEAPASPAPLSPLEVELDPEFEPQSRPRSCTWPLQRPELQASPAKPSGETAADSMIPEEEDDEDDEDGGGRAGSAMAIGGGGGSGTLGSGLLLEDSARVLAPGGQDPGSGPATAAGGLSGGTQALLQPQQPLPPPQPGAAGGSGQPRKCSSRRNAWGNLSYADLITRAIESSPDKRLTLSQIYEWMVRCVPYFKDKGDSNSSAGWKNSIRHNLSLHSRFMRVQNEGTGKSSWWIINPDGGKSGKAPRRRAVSMDNSNKYTKSRGRAAKKKAALQTAPESADDSPSQLSKWPGSPTSRSSDELDAWTDFRSRTNSNASTVSGRLSPIMASTELDEVQDDDAPLSPMLYSSSASLSPSVSKPCTVELPRLTDMAGTMNLNDGLTENLMDDLLDNITLPPSQPSPTGGLMQRSSSFPYTTKGSGLGSPTSSFNSTVFGPSSLNSLRQSPMQTIQENKPATFSSMSHYGNQTLQDLLTSDSLSHSDVMMTQSDPLMSQASTAVSAQNSRRNVMLRNDPMMSFAAQPNQGSLVNQNLLHHQHQTQGALGGSRALSNSVSNMGLSESSSLGSAKHQQQSPVSQSMQTLSDSLSGSSLYSTSANLPVMGHEKFPSDLDLDMFNGSLECDMESIIRSELMDADGLDFNFDSLISTQNVVGLNVGNFTGAKQASSQSWVPG

SEQ ID NO: 15012 - protein, 505 aa, Homo Sapiens
MDPGNENSATEAAAIIDLDPDFEPQSRPRSCTWPLPRPEIANQPSEPPEVEPDLGEKVHTEGRSEPILLPSRLPEPAGGPQPGILGAVTGPRKGGSRRNAWGNQSYAELISQAIESAPEKRLTLAQIYEWMVRTVPYFKDKGDSNSSAGWKNSIRHNLSLHSKFIKVHNEATGKSSWWMLNPEGGKSGKAPRRRAASMDSSSKLLRGRSKAPKKKPSVLPAPPEGATPTSPVGHFAKWSGSPCSRNREEADMWTTFRPRSSSNASSVSTRLSPLRPESEVLAEEIPASVSSYAGGVPPTLNEGLELLDGLNLTSSHSLLSRSGLSGFSLQHPGVTGPLHTYSSSLFSPAEGPLSAGEGCFSSSQALEALLTSDTPPPPADVLMTQVDPILSQAPTLLLLGGLPSSSKLATGVGLCPKPLEAPGPSSLVPTLSMIAPPPVMASAPIPKALGTPVLTPPTEAASQDRMPQDLDLDMYMENLECDMDNIISDLMDEGEGLDFNFEPDP

SEQ ID NO: 15013 - protein, 492 aa, Homo Sapiens
MAAKLRAHQVDVDPDFAPQSRPRSCTWPLPQPDLAGDEDGALGAGVAEGAEDCGPERRATAPAMAPAPPLGAEVGPLRKAKSSRRNAWGNLSYADLITKAIESAPDKRLTLSQIYDWMVRYVPYFKDKGDSNSSAGWKNSIRHNLSLHTRFIRVQNEGTGKSSWWMLNPEGGKTGKTPRRRAVSMDNGAKFLRIKGKASKKKQLQAPERSPDDSSPSAPAPGPVPAAAKWAASPASHASDDYEAWADFRGGGRPLLGEAAELEDDEALEALAPSSPLMYPSPASALSPALGSRCPGELPRLAELGGPLGLHGGGGAGLPEGLLDGAQDAYGPRPAPRPGPVLGAPGELALAGAAAAYPGKGAAPYAPPAPSRSALAHPISLMTLPGEAGAAGLAPPGHAAAFGGPPGGLLLDALPGPYAAAAAGPLGAAPDRFPADLDLDMFSGSLECDVESIILNDFMDSDEMDFNFDSALPPPPPGLAGAPPPNQSWVPG

SEQ ID NO: 15014 - protein, 677 aa, Homo Sapiens
MMQESGTETKSNGSAIQNGSGGSNHLLECGGLREGRSNGETPAVDIGAADLAHAQQQQQQALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 15015 - protein, 431 aa, Homo Sapiens
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 15016 - protein, 680 aa, Homo Sapiens
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQLQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPLNPVPGSSSFSKVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 15017 - protein, 403 aa, Homo Sapiens
MKLEVFVPRAAHGDKQGSDLEGAGGSDAPSPLSAAGDDSLGSDGDCAANSPAAGGGARDTQGDGEQSAGGGPGAEEAIPAAAAAAVVAEGAEAGAAGPGAGGAGSGEGARSKPYTRRPKPPYSYIALIAMAIRDSAGGRLTLAEINEYLMGKFPFFRGSYTGWRNSVRHNLSLNDCFVKVLRDPSRPWGKDNYWMLNPNSEYTFADGVFRRRRKRLSHRAPVPAPGLRPEEAPGLPAAPPPAPAAPASPRMRSPARQEERASPAGKFSSSFAIDSILRKPFRSRRLRDTAPGTTLQWGAAPCPPLPAFPALLPAAPCRALLPLCAYGAGEPARLGAREAEVPPTAPPLLLAPLPAAAPAKPLRGPAAGGAHLYCPLRLPAALQAASVRRPGPHLPYPVETLLA

SEQ ID NO: 15018 - protein, 292 aa, Homo Sapiens
MGNELFLAFTTSHLPLAEQKLARYKLRIVKPPKLPLEKKPNPDKDGPDYEPNLWMWVNPNIVYPPGKLEVSGRRKREDLTSTLPSSQPPQKEEDASCSEAAGVESLSQSSSKRSPPRKRFAFSPSTWELTEEEEAEDQEDSSSMALPSPHKRAPLQSRRLRQASSQAGRLWSRPPLNYFHLIALALRNSSPCGLNVQQIYSFTRKHFPFFRTAPEGWKNTVRHNLCFRDSFEKVPVSMQGGASTRPRSCLWKLTEEGHRRFAEEARALASTRLESIQQCMSQPDVMPFLFDL

SEQ ID NO: 15019 - protein, 311 aa, Homo Sapiens
MDLKLKDCEFWYSLHGQVPGLLDWDMRNELFLPCTTDQCSLAEQILAKYRVGVMKPPEMPQKRRPSPDGDGPPCEPNLWMWVDPNILCPLGSQEAPKPSGKEDLTNISPFPQPPQKDEGSNCSEDKVVESLPSSSSEQSPLQKQGIHSPSDFELTEEEAEEPDDNSLQSPEMKCYQSQKLWQINNQEKSWQRPPLNCSHLIALALRNNPHCGLSVQEIYNFTRQHFPFFWTAPDGWKSTIHYNLCFLDSFEKVPDSLKDEDNARPRSCLWKLTKEGHRRFWEETRVLAFAQRERIQECMSQPELLTSLFDL

SEQ ID NO: 15020 - protein, 330 aa, Homo Sapiens
MQQQPLPGPGAPTTEPTKPPYSYIALIAMAIQSSPGQRATLSGIYRYIMGRFAFYRHNRPGWQNSIRHNLSLNECFVKVPRDDRKPGKGSYWTLDPDCHDMFEHGSFLRRRRRFTRQTGAEGTRGPAKARRGPLRATSQDPGVPNATTGRQCSFPPELPDPKGLSFGGLVGAMPASMCPATTDGRPRPPMEPKEISTPKPACPGELPVATSSSSCPAFGFPAGFSEAESFNKAPTPVLSPESGIGSSYQCRLQALNFCMGADPGLEHLLASAAPSPAPPTPPGSLRAPLPLPTDHKEPWVAGGFPVQGGSGYPLGLTPCLYRTPGMFFFE

SEQ ID NO: 15021 - protein, 431 aa, Homo Sapiens; identical to SEQ ID NO: 15015

SEQ ID NO: 15022 - protein, 644 aa, Homo Sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGQ

SEQ ID NO: 15023 - protein, 572 aa, Homo Sapiens
MAELVQGQSAPVGMKAEGFVDALHRVRQIAAKIDSIPHLNNSTPLVDPSVYGYGVQKRPLDDGVGNQLGALVHQRTVITEEFKVPDKMVGFIIGRGGEQISRIQAESGCKIQIASESSGIPERPCVLTGTPESIEQAKRLLGQIVDRCRNGPGFHNDIDSNSTIQEILIPASKVGLVIGRGGETIKQLQERTGVKMVMIQDGPLPTGADKPLRITGDAFKVQQAREMVLEIIREKDQADFRGVRGDFNSRMGGGSIEVSVPRFAVGIVIGRNGEMIKKIQNDAGVRIQFKPDDGISPERAAQVMGPPDRCQHAAHIISELILTAQERDGFGGLAAARGRGRGRGDWSVGAPGGVQEITYTVPADKCGLVIGKGGENIKSINQQSGAHVELQRNPPPNSDPNLRRFTIRGVPQQIEVARQLIDEKVGGTNLGAPGAFGQSPFSQPPAPPHQNTFPPRSSGCFPNMAAKVNGNPHSTPVSGPPAFLTQGWGSTYQAWQQPTQQVPSQQSQPQSSQPNYSKAWEDYYKKQSHAASAAPQASSPPDYTMAWAEYYRQQVAFYGQTLGQAQAHSQEQ

SEQ ID NO: 15024 - protein, 454 aa, Homo Sapiens
MTKREAEELIEIEIDGTEKAECTEESIVEQTYAPAECVSQAIDINEPIGNLKKLLEPRLQCSLDAHEICLQDIQLDPERSLFDQGVKTDGTVQLSVQVISYQGIEPKLNILEIVKPADTVEVVIDPDAHHAESEAHLVEEAQVITLDGTKHITTISDETSEQVTRWAAALEGYRKEQERLGIPYDPIQWSTDQVLHWVVWVMKEFSMTDIDLTTLNISGRELCSLNQEDFFQRVPRGEILWSHLELLRKYVLASQEQQMNEIVTIDQPVQIIPASVQSATPTTIKVINSSAKAAKVQRAPRISGEDRSSPGNRTGNNGQIQLWQFLLELLTDKDARDCISWVGDEGEFKLNQPELVAQKWGQRKNKPTMNYEKLSRALRYYYDGDMICKVQGKRFVYKFVCDLKTLIGYSAAELNRLVTECEQKKLAKMQLHGIAQPVTAVALATASLQTEKDN

SEQ ID NO: 15025 - protein, 395 aa, Homo Sapiens
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTGLVSSENSSKATDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEEREALQKQLDEANREAQKYRQQLLKKEQEAEAYRQKLEAMTRLQTNKEAV

SEQ ID NO: 15026 - protein, 448 aa, Homo Sapiens
MSLVDLGKRLLEAARKGQDDEVRTLMANGAPFTTDWLGTSPLHLAAQYGHYSTAEVLLRAGVSRDARTKVDRTPLHMAAADGHAHIVELLVRNGADVNAKDMLKMTALHWATERHHRDVVELLIKYGADVHAFSKFDKSAFDIALEKNNAEILVILQEAMQNQVNVNPERANPVTDPVSMAAPFIFTSGEVVNLASLISSTNTKTTSGDPHASTVQFSNSTTSVLATLAALAEASVPLSNSHRATANTEEIIEGNSVDSSIQQVMGSGGQRVITIVTDGVPLGNIQTSIPTGGIGQPFIVTVQDGQQVLTVPAGKVAEETVIKEEEEEKLPLTKKPRIGEKTNSVEESKEGNERELLQQQLQEANRRAQEYRHQLLKKEQEAEQYRLKLEAIARQQPNGVDFTMVEEVAEVDAVVVTEGELEERETKVTGSAGTTEPHTRVSMATVSS

SEQ ID NO: 15027 - protein, 413 aa, Homo Sapiens
MEFPGLGSLGTSEPLPQFVDPALVSSTPESGVFFPSGPEGLDAAASSTAPSTATAAAAALAYYRDAEAYRHSPVFQVYPLLNCMEGIPGGSPYAGWAYGKTGLYPASTVCPTREDSPPQAVEDLDGKGSTSFLETLKTERLSPDLLTLGPALPSSLPVPNSAYGGPDFSSTFFSPTGSPLNSAAYSSPKLRGTLPLPPCEARECVNCGATATPLWRRDRTGHYLCNACGLYHKMNGQNRPLIRPKKRLIVSKRAGTQCTNCQTTTTTLWRRNASGDPVCNACGLYYKLHQVNRPLTMRKDGIQTRNRKASGKGKKKRGSSLGGTGAAEGPAGGFMVVAGGSGSGNCGEVASGLTLGPPGTAHLYQGLGPVVLSGPVSHLMPFPGPLLGSPTGSFPTGPMPPTTSTTVVAPLSS

SEQ ID NO: 15028 - protein, 480 aa, Homo Sapiens
MEVAPEQPRWMAHPAVLNAQHPDSHHPGLAHNYMEPAQLLPPDEVDVFFNHLDSQGNPYYANPAHARARVSYSPAHARLTGGQMCRPHLLHSPGLPWLDGGKAALSAAAAHHHNPWTVSPFSKTPLHPSAAGGPGGPLSVYPGAGGGSGGGSGSSVASLTPTAAHSGSHLFGFPPTPPKEVSPDPSTTGAASPASSSAGGSAARGEDKDGVKYQVSLTESMKMESGSPLRPGLATMGTQPATHHPIPTYPSYVPAAAHDYSSGLFHPGGFLGGPASSFTPKQRSKARSCSEGRECVNCGATATPLWRRDGTGHYLCNACGLYHKMNGQNRPLIKPKRRLSAARRAGTCCANCQTTTTTLWRRNANGDPVCNACGLYYKLHNVNRPLTMKKEGIQTRNRKMSNKSKKSKKGAECFEELSKCMQEKSSPFSAAALAGHMAPVGHLPPFSHSGHILPTPTPIHPSSSLSFGHPHPSSMVTAMG

SEQ ID NO: 15029 - protein, 443 aa, Homo Sapiens
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLSPFSKTSIHHGSPGPLSVYPPASSSSLSGGHASPHLFTFPPTPPKDVSPDPSLSTPGSAGSARQDEKECLKYQVPLPDSMKLESSHSRGSMTALGGASSSTHHPITTYPPYVPEYSSGLFPPSSLLGGSPTGFGCKSRPKARSSTGRECVNCGATSTPLWRRDGTGHYLCNACGLYHKMNGQNRPLIKPKRRLSAARRAGTSCANCQTTTTTLWRRNANGDPVCNACGLYYKLHNINRPLTMKKEGIQTRNRKMSSKSKKCKKVHDSLEDFPKNSSFNPAALSRHMSSLSHISPFSHSSHMLTTPTPMHPPSSLSFGPHHPSSMVTAMG

SEQ ID NO: 15030 - protein, 442 aa, Homo Sapiens
MYQSLAMAANHGPPPGAYEAGGPGAFMHGAGAASSPVYVPTPRVPSSVLGLSYLQGGGAGSASGGASGGSSGGAASGAGPGTQQGSPGWSQAGADGAAYTPPPVSPRFSFPGTTGSLAAAAAAAAAREAAAYSSGGGAAGAGLAGREQYGRAGFAGSYSSPYPAYMADVGASWAAAAAASAGPFDSPVLHSLPGRANPAARHPNLDMFDDFSEGRECVNCGAMSTPLWRRDGTGHYLCNACGLYHKMNGINRPLIKPQRRLSASRRVGLSCANCQTTTTTLWRRNAEGEPVCNACGLYMKLHGVPRPLAMRKEGIQTRKRKPKNLNKSKTPAAPSGSESLPPASGASSNSSNATTSSSEEMRPIKTEPGLSSHYGHSSSVSQTFSVSAMSGHGPSIHPVLSALKLSPQGYASPVSQSPQTSSKQDSWNSLVLADSHGDIITA

SEQ ID NO: 15031 - protein, 397 aa, Homo Sapiens
MYQSLALAASPRQAAYADSGSFLHAPGAGSPMFVPPARVPSMLSYLSGCEPSPQPPELAARPGWAQTATADSSAFGPGSPHPPAAHPPGATAFPFAHSPSGPGSGGSAGGRDGSAYQGALLPREQFAAPLGRPVGTSYSATYPAYVSPDVAQSWTAGPFDGSVLHGLPGRRPTFVSDFLEEFPGEGRECVNCGALSTPLWRRDGTGHYLCNACGLYHKMNGVNRPLVRPQKRLSSSRRAGLCCTNCHTTNTTLWRRNSEGEPVCNACGLYMKLHGVPRPLAMKKESIQTRKRKPKTIAKARGSSGSTRNASASPSAVASTDSSAATSKAKPSLASPVCPGPSMAPQASGQEDDSLAPGHLEFKFEPEDFAFPSTAPSPQAGLRGALRQEAWCALALA

SEQ ID NO: 15032 - protein, 595 aa, Homo Sapiens
MALTDGGWCLPKRFGAAGADASDSRAFPAREPSTPPSPISSSSSSCSRGGERGPGGASNCGTPQLDTEAAAGPPARSLLLSSYASHPFGAPHGPSAPGVAGPGGNLSSWEDLLLFTDLDQAATASKLLWSSRGAKLSPFAPEQPEEMYQTLAALSSQGPAAYDGAPGGFVHSAAAAAAAAAAASSPVYVPTTRVGSMLPGLPYHLQGSGSGPANHAGGAGAHPGWPQASADSPPYGSGGGAAGGGAAGPGGAGSAAAHVSARFPYSPSPPMANGAAREPGGYAAAGSGGAGGVSGGGSSLAAMGGREPQYSSLSAARPLNGTYHHHHHHHHHHPSPYSPYVGAPLTPAWPAGPFETPVLHSLQSRAGAPLPVPRGPSADLLEDLSESRECVNCGSIQTPLWRRDGTGHYLCNACGLYSKMNGLSRPLIKPQKRVPSSRRLGLSCANCHTTTTTLWRRNAEGEPVCNACGLYMKLHGVPRPLAMKKEGIQTRKRKPKNINKSKTCSGNSNNSIPMTPTSTSSNSDDCSKNTSPTTQPTASGAGAPVMTGAGESTNPENSELKYSGQDGLYIGVSLASPAEVTSSVRPDSWCALALA

SEQ ID NO: 15033 - protein, 269 aa, Homo Sapiens
MPLGLKPTCSVCKTTSSSMWKKGAQGEILCHHCTGRGGAGSGGAGSGAAGGTGGSGGGGFGAATFASTSATPPQSNGGGGGKQSKQEIHRRSARLRNTKYKSAPAAEKKVSTKGKGRRHIFKLKNPIKAPESVSTIITAESIFYKGVYYQIGDVVSVIDEQDGKPYYAQIRGFIQDQYCEKSAALTWLIPTLSSPRDQFDPASYIIGPEEDLPRKMEYLEFVCHAPSEYFKSRSSPFPTVPTRPEKGYIWTHVGPTPAITIKESVANHL

SEQ ID NO: 15034 - protein, 633 aa, Homo Sapiens
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQKPTGSVGSTVTTPPPLVRGTQNIPAGKPSLQTSSARMPGSVIPPPLVRGGQQASSKLGPQASSQVVMPPLVRGAQQIHSIRQHSSTGPPPLLLAPRASVPSVQIQGQRIIQQGLIRVANVPNTSLLVNIPQPTPASLKGTTATSAQANSTPTSVASVVTSAESPASRQAAAKLALRKQLEKTLLEIPPPKPPAPEMNFLPSAANNEFIYLVGLEEVVQNLLETQGRMSAATVLSREPYMCAQCKTDFTCRWREEKSGAIMCENCMTTNQKKALKVEHTSRLKAAFVKALQQEQEIEQRLLQQGTAPAQAKAEPTAAPHPVLKQVIKPRRKLAFRSGEARDWSNGAVLQASSQLSRGSATTPRGVLHTFSPSPKLQNSASATALVSRTGRHSERTVSAGKGSATSNWKKTPLSTGGTLAFVSPSLAVHKSSSAVDRQREYLLDMIPPRSIPQSATWK

SEQ ID NO: 15035 - protein, 593 aa, Homo Sapiens
MDRMTEDALRLNLLKRSLDPADERDDVLAKRLKMEGHEAMERLKMLALLKRKDLANLEVPHELPTKQDGSGVKGYEEKLNGNLRPHGDNRTAGRPGKENINDEPVDMSARRSEPERGRLTPSPDIIVLSDNEASSPRSSSRMEERLKAANLEMFKGKGIEERQQLIKQLRDELRLEEARLVLLKKLRQSQLQKENVVQKTPVVQNAASIVQPSPAHVGQQGLSKLPSRPGAQGVEPQNLRTLQGHSVIRSATNTTLPHMLMSQRVIAPNPAQLQGQRGPPKPGLVRTTTPNMNPAINYQPQSSSSVPCQRTTSSAIYMNLASHIQPGTVNRVSSPLPSPSAMTDAANSQAAAKLALRKQLEKTLLEIPPPKPPAPLLHFLPSAANSEFIYMVGLEEVVQSVIDSQGKSCASLLRVEPFVCAQCRTDFTPHWKQEKNGKILCEQCMTSNQKKALKAEHTNRLKNAFVKALQQEQEIEQRLQQQAALSPTTAPAVSSVSKQETIMRHHTLRQAPQPQSSLQRGIPTSARSMLSNFAQAPQLSVPGGLLGMPGVNIAYLNTGIGGHKGPSLADRQREYLLDMIPPRSISQSISGQK

SEQ ID NO: 15036 - protein, 363 aa, Homo Sapiens
MQRAGGGSAPGGNGGGGGGGPGTAFSIDSLIGPPPPRSGHLLYTGYPMFMPYRPLVLPQALAPAPLPAGLPPLAPLASFAGRLTNTFCAGLGQAVPSMVALTTALPSFAEPPDAFYGPQELAAAAAAAAATAARNNPEPGGRRPEGGLEADELLPAREKVAEPPPPPPPHFSETFPSLPAEGKVYSSDEEKLEASAGDPAGSEQEEEGSGGDSEDDGFLDSSAGGPGALLGPKPKLKGSLGTGAEEGAPVTAGVTAPGGKSRRRRTAFTSEQLLELEKEFHCKKYLSLTERSQIAHALKLSEVQVKIWFQNRRAKWKRIKAGNVSSRSGEPVRNPKIVVPIPVHVNRFAVRSQHQQMEQGARP

SEQ ID NO: 15037 - protein, 348 aa, Homo Sapiens
MSAAFPPSLMMMQRPLGSSTAFSIDSLIGSPPQPSPGHFVYTGYPMFMPYRPVVLPPPPPPPPALPQAALQPALPPAHPHHQIPSLPTGFCSSLAQGMALTSTLMATLPGGFSASPQHQEAAAARKFAPQPLPGGGNFDKAEALQADAEDGKGFLAKEGSLLAFSAAETVQASLVGAVRGQGKDESKVEDDPKGKEESFSLESDVDYSSDDNLTGQAAHKEEDPGHALEETPPSSGAAGSTTSTGKNRRRRTAFTSEQLLELEKEFHCKKYLSLTERSQIAHALKLSEVQVKIWFQNRRAKWKRVKAGNANSKTGEPSRNPKIVVPIPVHVSRFAIRSQHQQLEQARP

SEQ ID NO: 15038 - protein, 781 aa, Homo Sapiens
MAHRPKRTFRQRAADSSDSDGAEESPAEPGAPRELPVPGSAEEEPPSGGGRAQVAGLPHRVRGPRGRGRVWASSRRATKAAPRADEGSESRTLDVSTDEEDKIHHSSESKDDQGLSSDSSSSLGEKELSSTVKIPDAAFIQAARRKRELARAQDDYISLDVQHTSSISGMKRESEDDPESEPDDHEKRIPFTLRPQTLRQRMAEESISRNEETSEESQEDEKQDTWEQQQMRKAVKIIEERDIDLSCGNGSSKVKKFDTSISFPPVNLEIIKKQLNTRLTLLQETHRSHLREYEKYVQDVKSSKSTIQNLESSSNQALNCKFYKSMKIYVENLIDCLNEKIINIQEIESSMHALLLKQAMTFMKRRQDELKHESTYLQQLSRKDETSTSGNFSVDEKTQWILEEIESRRTKRRQARVLSGNCNHQEGTSSDDELPSAEMIDFQKSQGDILQKQKKVFEEVQDDFCNIQNILLKFQQWREKFPDSYYEAFISLCIPKLLNPLIRVQLIDWNPLKLESTGLKEMPWFKSVEEFMDSSVEDSKKESSSDKKVLSAIINKTIIPRLTDFVEFLWDPLSTSQTTSLITHCRVILEEHSTCENEVSKSRQDLLKSIVSRMKKAVEDDVFIPLYPKSAVENKTSPHSKFQERQFWSGLKLFRNILLWNGLLTDDTLQELGLGKLLNRYLIIALLNATPGPDVVKKCNQVAACLPEKWFENSAMRTSIPQLENFIQFLLQSAHKLSRSEFRDEVEEIILILVKIKALNQAESFIGEHHLDHLKSLIKED

SEQ ID NO: 15039 - protein, 436 aa, Homo Sapiens
MEPDDFDSEDKEILSWDINDVKLPQNVKKTDWFQEWPDSYAKHIYSSEDKNAQRHLSSWAMRNTNNHNSRILKKSCLGVVVCGRDCLAEEGRKIYLRPAICDKARQKQQRKRCPNCDGPLKLIPCRGHGGFPVTNFWRHDGRFIFFQSKGEHDHPKPETKLEAEARRAMKKVNTAPSSVSLSLKGSTETRSLPGETQSQGSLPLTWSFQEGVQLPGSYSGHLIANTPQQNSLNDCFSFSKSYGLGGITDLTDQTSTVDPMKLYEKRKLSSSRTYSSGDLLPPSASGVYSDHGDLQAWSKNAALGRNHLADNCYSNYPFPLTSWPCSFSPSQNSSEPFYQQLPLEPPAAKTGCPPLWPNPAGNLYEEKVHVDFNSYVQSPAYHSPQEDPFLFTYASHPHQQYSLPSKSSKWDFEEEMTYLGLDHCNNDMLLNLCPLR

SEQ ID NO: 15040 - protein, 506 aa, Homo Sapiens
MPAAAVQEAVGVCSYGMQLSWDINDPQMPQELALFDQFREWPDGYVRFIYSSDEKKAQRHLSGWAMRNTNNHNGHILKKSCLGVVVCTQACTLPDGSRLQLRPAICDKARLKQQKKACPNCHSALELIPCRGHSGYPVTNFWRLDGNAIFFQAKGVHDHPRPESKSETEARRSAIKRQMASFYQPQKKRIRESEAEENQDSSGHFSNIPPLENPEDFDIVTETSFPIPGQPCPSFPKSDVYKATCDLATFQGDKMPPFQKYSSPRIYLPRPPCSYELANPGYTNSSPYPTLYKDSTSIPNDTDWVHLNTLQCNVNSYSSYERSFDFTNKQHGWKPALGKPSLVERTNHGQFQAMATRPYYNPELPCRYLTTPPPGAPALQTVITTTTKVSYQAYQPPAMKYSDSVREVKSLSSCNYAPEDTGMSVYPEPWGPPVTVTRAASPSGPPPMKIAGDCRAIRPTVAIPHEPVSSRTDEAETWDVCLSGLGSAVSYSDRVGPFFTYNNEDF

SEQ ID NO: 15041 - protein, 422 aa, Homo Sapiens
MPRSFLVKSKKAHSYHQPRSPGPDYSLRLENVPAPSRADSTSNAGGAKAEPRDRLSPESQLTEAPDRASASPDSCEGSVCERSSEFEDFWRPPSPSASPASEKSMCPSLDEAQPFPLPFKPYSWSGLAGSDLRHLVQSYRPCGALERGAGLGLFCEPAPEPGHPAALYGPKRAAGGAGAGAPGSCSAGAGATAGPGLGLYGDFGSAAAGLYERPTAAAGLLYPERGHGLHADKGAGVKVESELLCTRLLLGGGSYKCIKCSKVFSTPHGLEVHVRRSHSGTRPFACEMCGKTFGHAVSLEQHKAVHSQERSFDCKICGKSFKRSSTLSTHLLIHSDTRPYPCQYCGKRFHQKSDMKKHTFIHTGEKPHKCQVCGKAFSQSSNLITHSRKHTGFKPFGCDLCGKGFQRKVDLRRHRETQHGLK

SEQ ID NO: 15042 - protein, 330 aa, Homo Sapiens
MPRSFLVKSKKAHTYHQPRVQEDEPLWPPALTPVPRDQAPSNSPVLSTLFPNQCLDWTNLKREPELEQDQNLARMAPAPEGPIVLSRPQDGDSPLSDSPPFYKPSFSWDTLATTYGHSYRQAPSTMQSAFLEHSVSLYGSPLVPSTEPALDFSLRYSPGMDAYHCVKCNKVFSTPHGLEVHVRRSHSGTRPFACDICGKTFGHAVSLEQHTHVHSQERSFECRMCGKAFKRSSTLSTHLLIHSDTRPYPCQFCGKRFHQKSDMKKHTYIHTGEKPHKCQVCGKAFSQSSNLITHSRKHTGFKPFSCELCTKGFQRKVDLRRHRESQHNLK

SEQ ID NO: 15043 - protein, 1106 aa, Homo Sapiens
MFNSMTPPPISSYGEPCCLRPLPSQGAPSVGTEGLSGPPFCHQANLMSGPHSYGPARETNSCTEGPLFSSPRSAVKLTKKRALSISPLSDASLDLQTVIRTSPSSLVAFINSRCTSPGGSYGHLSIGTMSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKCTFEGCRKSYSRLENLKTHLRSHTGEKPYMCEHEGCSKAFSNASDRAKHQNRTHSNEKPYVCKLPGCTKRYTDPSSLRKHVKTVHGPDAHVTKRHRGDGPLPRAPSISTVEPKREREGGPIREESRLTVPEGAMKPQPSPGAQSSCSSDHSPAGSAANTDSGVEMTGNAGGSTEDLSSLDEGPCIAGTGLSTLRRLENLRLDQLHQLRPIGTRGLKLPSLSHTGTTVSRRVGPPVSLERRSSSSSSISSAYTVSRRSSLASPFPPGSPPENGASSLPGLMPAQHYLLRARYASARGGGTSPTAASSLDRIGGLPMPPWRSRAEYPGYNPNAGVTRRASDPAQAADRPAPARVQRFKSLGCVHTPPTVAGGGQNFDPYLPTSVYSPQPPSITENAAMDARGLQEEPEVGTSMVGSGLNPYMDFPPTDTLGYGGPEGAAAEPYGARGPGSLPLGPGPPTNYGPNPCPQQASYPDPTQETWGEFPSHSGLYPGPKALGGTYSQCPRLEHYGQVQVKPEQGCPVGSDSTGLAPCLNAHPSEGPPHPQPLFSHYPQPSPPQYLQSGPYTQPPPDYLPSEPRPCLDFDSPTHSTGQLKAQLVCNYVQSQQELLWEGGGREDAPAQEPSYQSPKFLGGSQVSPSRAKAPVNTYGPGFGPNLPNHKSGSYPTPSPCHENFVVGANRASHRAAAPPRLLPPLPTCYGPLKVGGTNPSCGHPEVGRLGGGPALYPPPEGQVCNPLDSLDLDNTQLDFVAILDEPQGLSPPPSHDQRGSSGHTPPPSGPPNMAVGNMSVLLRSLPGETEFLNSSA

SEQ ID NO: 15044 - protein, 1586 aa, Homo Sapiens
METSASATASEKQEAKSGILEAAGFPDPGKKASPLVVAAAAAAAVAAQGVPQHLLPPFHAPLPIDMRHQEGRYHYEPHSVHGVHGPPALSGSPVISDISLIRLSPHPAGPGESPFNAPHPYVNPHMEHYLRSVHSSPTLSMISAARGLSPADVAQEHLKERGLFGLPAPGTTPSDYYHQMTLVAGHPAPYGDLLMQSGGAASAPHLHDYLNPVDVSRFSSPRVTPRLSRKRALSISPLSDASLDLQRMIRTSPNSLVAYINNSRSSSAASGSYGHLSAGALSPAFTFPHPINPVAYQQILSQQRGLGSAFGHTPPLIQPSPTFLAQQPMALTSINATPTQLSSSSNCLSDTNQNKQSSESAVSSTVNPVAIHKRSKVKTEPEGLRPASPLALTQGQVSGHGSCGCALPLSQEQLADLKEDLDRDDCKQEAEVVIYETNCHWEDCTKEYDTQEQLVHHINNEHIHGEKKEFVCRWQACTREQKPFKAQYMLVVHMRRHTGEKPHKCTFEGCSKAYSRLENLKTHLRSHTGEKPYVCEHEGCNKAFSNASDRAKHQNRTHSNEKPYICKIPGCTKRYTDPSSLRKHVKTVHGPDAHVTKKQRNDVHLRTPLLKENGDSEAGTEPGGPESTEASSTSQAVEDCLHVRAIKTESSGLCQSSPGAQSSCSSEPSPLGSAPNNDSGVEMPGTGPGSLGDLTALDDTPPGADTSALAAPSAGGLQLRKHMTTMHRFEQLKKEKLKSLKDSCSWAGPTPHTRNTKLPPLPGSGSILENFSGSGGGGPAGLLPNPRLSELSASEVTMLSQLQERRDSSTSTVSSAYTVSRRSSGISPYFSSRRSSEASPLGAGRPHNASSADSYDPISTDASRRSSEASQCSGGSGLLNLTPAQQYSLRAKYAAATGGPPPTPLPGLERMSLRTRLALLDAPERTLPAGCPRPLGPRRGSDGPTYGHGHAGAAPAFPHEAPGGGARRASDPVRRPDALSLPRVQRFHSTHNVNPGPLPPCADRRGLRLQSHPSTDGGLARGAYSPRPPSISENVAMEAVAAGVDGAGPEADLGLPEDDLVLPDDVVQYIKAHASGALDEGTGQVYPTESTGFSDNPRLPSPGLHGQRRMVAADSNVGPSAPMLGGCQLGFGAPSSLNKNNMPVQWNEVSSGTVDALASQVKPPPFPQGNLAVVQQKPAFGQYPGYSPQGLQASPGGLDSTQPHLQPRSGAPSQGIPRVNYMQQLRQPVAGSQCPGMTTTMSPHACYGQVHPQLSPSTISGALNQFPQSCSNMPAKPGHLGHPQQTEVAPDPTTMGNRHRELGVPDSALAGVPPPHPVQSYPQQSHHLAASMSQEGYHQVPSLLPARQPGFMEPQTGPMGVATAGFGLVQPRPPLEPSPTGRHRGVRAVQQQLAYARATGHAMAAMPSSQETAEAVPKGAMGNMGSVPPQPPPQDAGGAPDHSMLYYYGQIHMYEQDGGLENLGSCQVMRSQPPQPQACQDSIQPQPLPSPGVNQVSSTVDSQLLEAPQIDFDAIMDDGDHSSLFSGALSPSLLHSLSQNSSRLTTPRNSLTLPSIPAGISNMAVGDMSSMLTSLAEESKFLNMMT

SEQ ID NO: 15045 - protein, 1580 aa, Homo Sapiens
MEAQSHSSTTTEKKKVENSIVKCSTRTDVSEKAVASSTTSNEDESPGQTYHRERRNAITMQPQNVQGLSKVSEEPSTSSDERASLIKKEIHGSLPHVAEPSVPYRGTVFAMDPRNGYMEPHYHPPHLFPAFHPPVPIDARHHEGRYHYDPSPIPPLHMTSALSSSPTYPDLPFIRISPHRNPTAASESPFSPPHPYINPYMDYIRSLHSSPSLSMISATRGLSPTDAPHAGVSPAEYYHQMALLTGQRSPYADIIPSAATAGTGAIHMEYLHAMDSTRFSSPRLSARPSRKRTLSISPLSDHSFDLQTMIRTSPNSLVTILNNSRSSSSASGSYGHLSASAISPALSFTYSSAPVSLHMHQQILSRQQSLGSAFGHSPPLIHPAPTFPTQRPIPGIPTVLNPVQVSSGPSESSQNKPTSESAVSSTGDPMHNKRSKIKPDEDLPSPGARGQQEQPEGTTLVKEEGDKDESKQEPEVIYETNCHWEGCAREFDTQEQLVHHINNDHIHGEKKEFVCRWLDCSREQKPFKAQYMLVVHMRRHTGEKPHKCTFEGCTKAYSRLENLKTHLRSHTGEKPYVCEHEGCNKAFSNASDRAKHQNRTHSNEKPYVCKIPGCTKRYTDPSSLRKHVKTVHGPEAHVTKKQRGDIHPRPPPPRDSGSHSQSRSPGRPTQGALGEQQDLSNTTSKREECLQVKTVKAEKPMTSQPSPGGQSSCSSQQSPISNYSNSGLELPLTDGGSIGDLSAIDETPIMDSTISTATTALALQARRNPAGTKWMEHVKLERLKQVNGMFPRLNPILPPKAPAVSPLIGNGTQSNNTCSLGGPMTLLPGRSDLSGVDVTMLNMLNRRDSSASTISSAYLSSRRSSGISPCFSSRRSSEASQAEGRPQNVSVADSYDPISTDASRRSSEASQSDGLPSLLSLTPAQQYRLKAKYAAATGGPPPTPLPNMERMSLKTRLALLGDALEPGVALPPVHAPRRCSDGGAHGYGRRHLQPHDAPGHGVRRASDPVRTGSEGLALPRVPRFSSLSSCNPPAMATSAEKRSLVLQNYTRPEGGQSRNFHSSPCPPSITENVTLESLTMDADANLNDEDFLPDDVVQYLNSQNQAGYEQHFPSALPDDSKVPHGPGDFDAPGLPDSHAGQQFHALEQPCPEGSKTDLPIQWNEVSSGSADLSSSKLKCGPRPAVPQTRAFGFCNGMVVHPQNPLRSGPAGGYQTLGENSNPYGGPEHLMLHNSPGSGTSGNAFHEQPCKAPQYGNCLNRQPVAPGALDGACGAGIQASKLKSTPMQGSGGQLNFGLPVAPNESAGSMVNGMQNQDPVGQGYLAHQLLGDSMQHPGAGRPGQQMLGQISATSHINIYQGPESCLPGAHGMGSQPSSLAVVRGYQPCASFGGSRRQAMPRDSLALQSGQLSDTSQTCRVNGIKMEMKGQPHPLCSNLQNYSGQFYDQTVGFSQQDTKAGSFSISDASCLLQGTSAKNSELLSPGANQVTSTVDSLDSHDLEGVQIDFDAIIDDGDHSSLMSGALSPSIIQNLSHSSSRLTTPRASLPFPALSMSTTNMAIGDMSSLLTSLAEESKFLAVMQ

SEQ ID NO: 15046 - protein, 376 aa, Homo Sapiens
MAALGDIQESPSVPSPVSLSSPGTPGTQHHEPQLHLHGHQHGSPGSSPKVLSQPSDLDLQDVEEVEIGRDTFWPDSEPKPEQAPRSPGSQAPDEGAGGALRSLLRSLPRRARCSAGFGPESSAERPAGQPPGAVPCAQPRGAWRVTLVQQAAAGPEGAPERAAELGVNFGRSRQGSARGAKPHRCEACGKSFKYNSLLLKHQRIHTGEKPYACHECGKRFRGWSGFIQHHRIHTGEKPYECGQCGRAFSHSSHFTQHLRIHNGEKPYKCGECGQAFSQSSNLVRHQRLHTGEKPYACSQCGKAFIWSSVLIEHQRIHTGEKPYECSDCGKAFRGRSHFFRHLRTHTGEKPFACGACGKAFGQSSQLIQHQRVHYRE

SEQ ID NO: 15047 - protein, 620 aa, Homo Sapiens
MAEARTSLSAHCRGPLATGLHPDLDLPGRSLATPAPSCYLLGSEPSSGLGLQPETHLPEGSLKRCCVLGLPPTSPASSSPCASSDVTSIIRSSQTSLVTCVNGLRSPPLTGDLGGPSKRARPGPASTDSHEGSLQLEACRKASFLKQEPADEFSELFGPHQQGLPPPYPLSQLPPGPSLGGLGLGLAGRVVAGRQACRWVDCCAAYEQQEELVRHIEKSHIDQRKGEDFTCFWAGCVRRYKPFNARYKLLIHMRVHSGEKPNKCMFEGCSKAFSRLENLKIHLRSHTGEKPYLCQHPGCQKAFSNSSDRAKHQRTHLDTKPYACQIPGCSKRYTDPSSLRKHVKAHSAKEQQVRKKLHAGPDTEADVLTECLVLQQLHTSTQLAASDGKGGCGLGQELLPGVYPGSITPHNGLASGLLPPAHDVPSRHHPLDATTSSHHHLSPLPMAESTRDGLGPGLLSPIVSPLKGLGPPPLPPSSQSHSPGGQPFPTLPSKPSYPPFQSPPPPPLPSPQGYQGSFHSIQSCFPYGDCYRMAEPAAGGDGLVGETHGFNPLRPNGYHSLSTPLPATGYEALAEASCPTALPQQPSEDVVSSGPEDCGFFPNGAFDHCLGHIPSIYTDT

SEQ ID NO: 15048 - protein, 524 aa, Homo Sapiens
MHSLDEPLDLKLSITKLRAAREKRERTLGVVRPRALHRELGLVDDSPTPGSPGSPPSGFLLNSKFPEKVEGRFSAAPLVDLSLSPPSGLDSPNGSSSLSPERQGNGDLPPVPSASDFQPLRYLDGVPSSFQFFLPLGSGGALHLPASSFLTPPKDKCLSPDLPLPKQLVCRWAKCNQLFELLQDLVDHVNDYHVKPEKDAGYCCHWEGCARHGRGFNARYKMLIHIRTHTNEKPHRCPTCSKSFSRLENLKIHNRSHTGEKPYVCPYEGCNKRYSNSSDRFKHTRTHYVDKPYYCKMPGCHKRYTDPSSLRKHIKAHGHFVSHEQQELLQLRPPPKPPLPAPDGGPYVSGAQIIIPNPAALFGGPGLPGLPLPLAPGPLDLSALACGNGGGSGGGGGMGPGLPGPVLPLNLAKNPLLPSPFGAGGLGLPVVSLLAGAAGGKAEGEKGRGSVPTRALGMEGHKTPLERTESSCSRPSPDGLPLLPGTVLDLSTGVNSAASSPEALAPGWVVIPPGSVLLKPAVVN

SEQ ID NO: 15049 - protein, 775 aa, Homo Sapiens; identical to SEQ ID NO: 6017

SEQ ID NO: 15050 - protein, 573 aa, Homo Sapiens
MANAEVSVPVGDVVVVPTEGNEGENPEDTKTQVILQLQPVQQGLFIDGHFYNRIYEAGSENNTAVVAVETHTIHKIEEGIDTGTIEANEDMEIAYPITCGESKAILLWKKFVCPGINVKCVKFNDQLISPKHFVHLAGKSTLKDWKRAIRLGGIMLRKMMDSGQIDFYQHDKVCSNTCRSTKFDLLISSARAPVPGQQTSVVQTPTSADGSITQIAISEESMEEAGLEWNSALTAAVTMATEEGVKKDSEEISEDTLMFWKGIADVGLMEEVVCNIQKEIEELLRGVQQRLIQAPFQVTDAAVLNNVAHTFGLMDTVKKVLDNRRNQVEQGEEQFLYTLTDLERQLEEQKKQGQDHRLKSQTVQNVVLMPVSTPKPPKRPRLQRPASTTVLSPSPPVQQPQFTVISPITITPVGQSFSMGNIPVATLSQGSSPVTVHTLPSGPQLFRYATVVSSAKSSSPDTVTIHPSSSLALLSSTAMQDGSTLGNMTTMVSPVELVAMESGLTSAIQAVESTSEDGQTIIEIDPAPDPEAEDTEGKAVILETELRTEEKVVAEMEEHQHQVHNVEIVVLED

SEQ ID NO: 15051 - protein, 530 aa, Homo Sapiens
MATPDVSVHMEEVVVVTTPDTAVDGSGVEGVKTVLVTTNLAPHGGDLTEDNMETENAAAAAAAAFTASSQLKEAVLVKMAEEGENLEAEIVYPITCGDSRANLIWRKFVCPGINVKCVQYDEHVISPKEFVHLAGKSTLKDWKRAIRMNGIMLRKIMDSGELDFYQHDKVCSNTCRSTKIDLSGARVSLSSPTSAEYIPLTPAAADVNGSPATITIETCEDPGDWTAAIGDDTFTFWRGLKDAGLLDEVIQEFHQELVETMRGLQQRVQDPPLQLRDAVLLNNIVQNFGMLDLVKKVLASHKCQMDRSREQYARDLAALEQQCDEHRRRAKELKHKSQHLSNVLMTLTPVSLPPPVKRPRLARATSGPAAMASQVLTQSAQLALGPGVPVPQLTSVPLGKVVSTLPSTVLGKGSLQAPPASSPASPLLGGYTVLASSGSTYPSTVEIHPDASSLTVLSTAAVQDGSTVFKVVSPLQLLTLPGLGPTLQNVAQASPGSSTIVTVPAGAAPGPEEHTATIEVAAMAEDHERK

SEQ ID NO: 15052 - protein, 2241 aa, Homo Sapiens
MLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDETAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQHVQLLTQIHLLATCNPNLNPEATTTRIFLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKIVFTKAEDNLLALGLKHFEGTEFPNPLISKYLLTCKTAHQLTVRIKNLNMNRAPDNIIKFYKKTKQLPVLGKCCEEIQPHQWKPPIEREEHRLPFWLKASLPSIQEELRHMADGAREVGNMTGTTEINSDRSLEKDNLELGSESRYPLLLPKGVVLKLKPVATRFPRKAWRQKRSSVLKPLLIQPSPSLQPSFNPGKTPARSTHSEAPPSKMVLRIPHPIQPATVLQTVPGVPPLGVSGGESFESPAALPAVPPEARTSFPLSESQTLLSSAPVPKVMLPSLAPSKFRKPYVRRRPSKRRGVKASPCMKPAPVIHHPASVIFTVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQETMEKLTWLASERRMSQEGESEEENSQEENSEPEEEEEEEAEGMESLQKEDEMTDEAVGDSAEKPPTFASPETAPEVETSRTPPGESIKAAGKGRNNHRARNKRGSRARASKDTSKLLLLYDEDILERDPLREQKDLAFAQAYLTRVREALQHIPGKYEDFLQVIYEFESSTQRRTAVDLYKSLQILLQDWPQLLKDFAAFLLPEQALACGLFEEQQAFEKSRKFLRQLEICFAENPSHHQKIIKVLQGCADCLPQEITELKTQMWQLLKGHDHLQDEFSIFFDHLRPAASRMGDFEEINWTEEKEYEFDGFEEVALPDVEEEEEPPKIPTASKNKRKKEIGVQNHDKETEWPDGAKDCACSCHEGGPDSKLKKSKRRSCSHCSSKVCDSKSYKSKEPHELVGSSPHREASPMPGAKEAGQGKDMMEEEAPEERESTEATQSRTVRTTRKGEMPVSAGLAVGSTLPSPREVTVTERLLLDGPPPHSPETPQFPPTTGAVLYTVKRNQVGPEVRSCPKASPRLQKEREGQKAVSESEALMLVWDASETEKLPGTVEPPASFLSPVSSKTRDAGRRHVSGKPDTQERWLPSSRARVKTRDRTCPVHESPSGIDTSETSPKAPRGGLAKDSGTQAKGPEGEQQPKAAEATVCANNSKVSSTGEKVVLWTREADRVILTMCQEQGAQPQTFNIISQQLGNKTPAEVSHRFRELMQLFHTACEASSEDEDDATSTSNADQLSDHGDLLSEEELDE

SEQ ID NO: 15053 - protein, 618 aa, Homo Sapiens
MTQEYDNKRPVLVLQNEALYPQRRSYTSEDEAWKSFLENPLTAATKAMMSINGDEDSAAALGLLYDYYKVPRERRSSTAKPEVEHPEPDHSKRNSIPIVTEQPLISAGENRVQVLKNVPFNIVLPHGNQLGIDKRGHLTAPDTTVTVSIATMPTHSIKTETQPHGFAVGIPPAVYHPEPTERVVVFDRNLNTDQFSSGAQAPNAQRRTPDSTFSETFKEGVQEVFFPSDLSLRMPGMNSEDYVFDSVSGNNFEYTLEASKSLRQKPGDSTMTYLNKGQFYPITLKEVSSSEGIHHPISKVRSVIMVVFAEDKSREDQLRHWKYWHSRQHTAKQRCIDIADYKESFNTISNIEEIAYNAISFTWDINDEAKVFISVNCLSTDFSSQKGVKGLPLNIQVDTYSYNNRSNKPVHRAYCQIKVFCDKGAERKIRDEERKQSKRKVSDVKVPLLPSHKRMDITVFKPFIDLDTQPVLFIPDVHFANLQRGTHVLPIASEELEGEGSVLKRGPYGTEDDFAVPPSTKLARIEEPKRVLLYVRKESEEVFDALMLKTPSLKGLMEAISDKYDVPHDKIGKIFKKCKKGILVNMDDNIVKHYSNEDTFQLQIEEAGGSYKLTLTEI

SEQ ID NO: 15054 - protein, 625 aa, Homo Sapiens
MSQESDNNKRLVALVPMPSDPPFNTRRAYTSEDEAWKSYLENPLTAATKAMMSINGDEDSAAALGLLYDYYKVPRDKRLLSVSKASDSQEDQEKRNCLGTSEAQSNLSGGENRVQVLKTVPVNLSLNQDHLENSKREQYSISFPESSAIIPVSGITVVKAEDFTPVFMAPPVHYPRGDGEEQRVVIFEQTQYDVPSLATHSAYLKDDQRSTPDSTYSESFKDAATEKFRSASVGAEEYMYDQTSSGTFQYTLEATKSLRQKQGEGPMTYLNKGQFYAITLSETGDNKCFRHPISKVRSVVMVVFSEDKNRDEQLKYWKYWHSRQHTAKQRVLDIADYKESFNTIGNIEEIAYNAVSFTWDVNEEAKIFITVNCLSTDFSSQKGVKGLPLMIQIDTYSYNNRSNKPIHRAYCQIKVFCDKGAERKIRDEERKQNRKKGKGQASQTQCNSSSDGKLAAIPLQKKSDITYFKTMPDLHSQPVLFIPDVHFANLQRTGQVYYNTDDEREGGSVLVKRMFRPMEEEFGPVPSKQMKEEGTKRVLLYVRKETDDVFDALMLKSPTVKGLMEAISEKYGLPVEKIAKLYKKSKKGILVNMDDNIIEHYSNEDTFILNMESMVEGFKVTLMEI

SEQ ID NO: 15055 - protein, 626 aa, Homo Sapiens; identical to SEQ ID NO: 6189

SEQ ID NO: 15056 - protein, 257 aa, Homo Sapiens
MPASMFSIDNILAARPRCKDSVLPVAHSAAAPVVFPALHGDSLYGASGGASSDYGAFYPRPVAPGGAGLPAAVSGSRLGYNNYFYGQLHVQAAPVGPACCGAVPPLGAQQCSCVPTPPGYEGPGSVLVSPVPHQMLPYMNVGTLSRTELQLLNQLHCRRKRRHRTIFTDEQLEALENLFQETKYPDVGTREQLARKVHLREEKVEVWFKNRRAKWRRQKRSSSEESENAEKWNKTSSSKASPEKREEEGKSDLDSDS

SEQ ID NO: 15057 - protein, 205 aa, Homo Sapiens
MAAAAGGAASRRGAGRPCPFSIEHILSSLPERSLPARAACPPQPAGRQSPAKPEEPGAPEAAPCACCCCCGPRAAPCGPPEAAAGLGARLAWPLRLGPAVPLSLGAPAGGSGALPGAVGPGSQRRTRRHRTIFSEEQLQALEALFVQNQYPDVSTRERLAGRIRLREERVEVWFKNRRAKWRHQKRASASARLLPGVKKSPKGSC

SEQ ID NO: 15058 - protein, 264 aa, Homo Sapiens
MPRSFLVDSLVLREAGEKKAPEGSPPPLFPYAVPPPHALHGLSPGACHARKAGLLCVCPLCVTASQLHGPPGPPALPLLKASFPPFGSQYCHAPLGRQHSAVSPGVAHGPAAAAAAAALYQTSYPLPDPRQFHCISVDSSSNQLPSSKRMRTAFTSTQLLELEREFASNMYLSRLRRIEIATYLNLSEKQVKIWFQNRRVKHKKEGKGSNHRGGGGGGAGGGGSAPQGCKCASLSSAKCSEDDDELPMSPSSSGKDDRDLTVTP

SEQ ID NO: 15059 - protein, 304 aa, Homo Sapiens
MSRSFYVDSLIIKDTSRPAPSLPEPHPGPDFFIPLGMPPPLVMSVSGPGCPSRKSGAFCVCPLCVTSHLHSSRGSVGAGSGGAGAGVTGAGGSGVAGAAGALPLLKGQFSSAPGDAQFCPRVNHAHHHHHPPQHHHHHHQPQQPGSAAAAAAAAAAAAAAAALGHPQHHAPVCTATTYNVADPRRFHCLTMGGSDASQVPNGKRMRTAFTSTQLLELEREFSSNMYLSRLRRIEIATYLNLSEKQVKIWFQNRRVKHKKEGKGTQRNSHAGCKCVGSQVHYARSEDEDSLSPASANDDKEISPL

SEQ ID NO: 15060 - protein, 998 aa, Homo Sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQAGPSETDDVDEKQPLSKPLQGSHHSSEGNEGTEMEVPAEDSTQHVPSETSEDPEVEVTIEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 15061 - protein, 365 aa, Homo Sapiens
MDPPAVVAESVSSLTIADAFIAAGESSAPTPPRPALPRRFICSFPDCSANYSKAWKLDAHLCKHTGERPFVCDYEGCGKAFIRDYHLSRHILTHTGEKPFVCAANGCDQKFNTKSNLKKHFERKHENQQKQYICSFEDCKKTFKKHQQLKIHQCQHTNEPLFKCTQEGCGKHFASPSKLKRHAKAHEGYVCQKGCSFVAKTWTELLKHVRETHKEEILCEVCRKTFKRKDYLKQHMKTHAPERDVCRCPREGCGRTYTTVFNLQSHILSFHEESRPFVCEHAGCGKTFAMKQSLTRHAVVHDPDKKKMKLKVKKSREKRSLASHLSGYIPPKRKQGQGLSLCQNGESPNCVEDKMLSTVAVLTLG

SEQ ID NO: 15062 - protein, 711 aa, Homo Sapiens
MESGAVLLESKSSPFNLLHEMHELRLLGHLCDVTVSVEYQGVRKDFMAHKAVLAATSKFFKEVFLNEKSVDGTRTNVYLNEVQVADFASFLEFVYTAKVQVEEDRVQRMLEVAEKLKCLDLSETCFQLKKQMLESVLLELQNFSESQEVEVSSGSQVSAAPAPRASVATDGPHPSGLTDSLDYPGERASNGMSSDLPPKKSKDKLDKKKEVVKPPYPKIRRASGRLAGRKVFVEIPKKKYTRRLREQQKTAEGDVGDYRCPQDQSPDRVGTEMEQVSKNEGCQAGAELEELSKKAGPEEEEEEEEEDEEGEKKKSNFKCSICEKAFLYEKSFLKHSKHRHGVATEVVYRCDTCGQTFANRCNLKSHQRHVHSSERHFPCELCGKKFKRKKDVKRHVLQVHEGGGERHRCGQCGKGLSSKTALRLHERTHTGDRPYGCTECGARFSQPSALKTHMRIHTGEKPFVCDECGARFTQNHMLIYHKRCHTGERPFMCETCGKSFASKEYLKHHNRIHTGSKPFKCEVCFRTFAQRNSLYQHIKVHTGERPYCCDQCGKQFTQLNALQRHRRIHTGERPFMCNACGRTFTDKSTLRRHTSIHDKNTPWKSFLVIVDGSPKNDDGHKTEQPDEEYVSSKLSDKLLSFAENGHFHNLAAVQDTVPTMQENSSADTACKADDSVVSQDTLLATTISELSELTPQTDSMPTQLHSLSNME

SEQ ID NO: 15063 - protein, 215 aa, Homo Sapiens
MNLVGSYAHHHHHHHPHPAHPMLHEPFLFGPASRCHQERPYFQSWLLSPADAAPDFPAGGPPPAAAAAATAYGPDARPGQSPGRLEALGGRLGRRKGSGPKKERRRTESINSAFAELRECIPNVPADTKLSKIKTLRLATSYIAYLMDVLAKDAQSGDPEAFKAELKKADGGRESKRKRELQQHEGFPPALGPVEKRIKGRTGWPQQVWALELNQ

SEQ ID NO: 15064 - protein, 217 aa, Homo Sapiens
MSLVGGFPHHPVVHHEGYPFAAAAAAAAAAAASRCSHEENPYFHGWLIGHPEMSPPDYSMALSYSPEYASGAAGLDHSHYGGVPPGAGPPGLGGPRPVKRRGTANRKERRRTQSINSAFAELRECIPNVPADTKLSKIKTLRLATSYIAYLMDLLAKDDQNGEAEAFKAEIKKTDVKEEKRKKELNEILKSTVSSNDKKTKGRTGWPQHVWALELKQ

SEQ ID NO: 15065 - protein, 514 aa, Homo Sapiens
MVWEVKTNQMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEVDWLTELANIATSPQSPLMQCSFYNRSSPVHIIATSKSLHSYARPPPVSSSSKSEPAFPHHHWKEETPVRHERANSESESGIFCMSSLSDDDDLGWCNSWPSTVWHCFLKGTRLCFHKGSNKEWQDVEDFARAEGCDNEEDLQMGIHKGYGSDGLKLLSHEESVSFGESVLKLTFDPGTVEDGLLTVECKLDHPFYVKNKGWSSFYPSLTVVQHGIPCCEVHIGDVCLPPGHPDAINFDDSGVFDTFKSYDFTPMDSSAVYVLSSMARQRRASLSCGGPGGQDFARSGFSKNCGSPGSSQLSSNSLYAKAVKNHSSGTVSATSPNKCKRPMNAFMLFAKKYRVEYTQMYPGKDNRAISVILGDRWKKMKNEERRMYTLEAKALAEEQKRLNPDCWKRKRTNSGSQQH

SEQ ID NO: 15066 - protein, 184 aa, Homo Sapiens
MKALGAVLLALLLCGRPGRGQTQQEEEEEDEDHGPDDYDEEDEDEVEEEETNRLPGGRSRVLLRCYTCKSLPRDERCNLTQNCSHGQTCTTLIAHGNTESGLLTTHSTWCTDSCQPITKTVEGTQVTMTCCQSSLCNVPPWQSSRVQDPTGKGAGGPRGSSETVGAALLLNLLAGLGAMGARRP

SEQ ID NO: 15067 - protein, 690 aa, Homo Sapiens
MNLRSVFTVEQQRILQRYYENGMTNQSKNCFQLILQCAQETKLDFSVVRTWVGNKRRKMSSKNSESGTATTGTSLSAPDITVRNVVNIARPSSQQSSWTSANNDVIVTGIYSPASSSSRQGTNKHTDTQITEAHKIPIQKTATKNDTEFQLHIPVQRQVAHCKNASLLLGEKTIILSRQTSVLNAGNSVFNHAKKNYGNSSVQASEMTVPQKPSVCHRPCKIEPVGIQRSYKPEHTGPALHNLCGQKPTIRDPYCRTQNLEIREVFSLAVSDYPQRILGGNAPQKPSSAEGNCLSIAMETGDAEDEYAREEELASMRAQIPSYSRFYESGSSLRAENQSTTLPGPGRNMPNSQMVNIRDMSDNVLYQNRNYHLTPRTSLHTASSTMYSNTNPLRSNFSPHFASSNQLRLSQNQNNYQISGNLTVPWITGCSRKRALQDRTQFSDRDLATLKKYWDNGMTSLGSVCREKIEAVATELNVDCEIVRTWIGNRRRKYRLMGIEVPPPRGGPADFSEQPESGSLSALTPGEEAGPEVGEDNDRNDEVSICLSEGSSQEEPNEVVPNDARAHKEEDHHAVTTDNVKIEIIDDEESDMISNSEVEQVNSFLDYKNEEVKFIENELEIQKQKYFKLQTFVRSLILAMKADDKEQQQALLSDLPPELEEMDFNHASLEPDDTSFSVSSLSEKNVSESL

SEQ ID NO: 15068 - protein, 242 aa, Homo Sapiens
MSDKLKERKRTPVSHKVIEKRRRDRINRCLNELGKTVPMALAKQSSGKLEKAEILEMTVQYLRALHSADFPRGREKAELLAEFANYFHYGYHECMKNLVHYLTTVERMETKDTKYARILAFLQSKARLGAEPAFPPLGSLPEPDFSYQLHPAGPEFAGHSPGEAAVFPQGSGAGPFPWPPGAARSPALPYLPSAPVPLASPAQQHSPFLTPVQGLDRHYLNLIGHAHPNALNLHTPQHPPVL

SEQ ID NO: 15069 - protein, 268 aa, Homo Sapiens; identical to SEQ ID NO: 5534

SEQ ID NO: 15070 - protein, 280 aa, Homo Sapiens
MPADIMEKNSSSPVAATPASVNTTPDKPKTASEHRKSSKPIMEKRRRARINESLSQLKTLILDALKKDSSRHSKLEKADILEMTVKHLRNLQRAQMTAALSTDPSVLGKYRAGFSECMNEVTRFLSTCEGVNTEVRTRLLGHLANCMTQINAMTYPGQPHPALQAPPPPPPGPGGPQHAPFAPPPPLVPIPGGAAPPPGGAPCKLGSQAGEAAKVFGGFQVVPAPDGQFAFLIPNGAFAHSGPVIPVYTSNSGTSVGPNAVSPSSGPSLTADSMWRPWRN

SEQ ID NO: 15071 - protein, 173 aa, Homo Sapiens
MGLPRRAGDAAELRKSLKPLLEKRRRARINQSLSQLKGLILPLLGRENSNCSKLEKADVLEMTVRFLQELPASSWPTAAPLPCDSYREGYSACVARLARVLPACRVLEPAVSARLLEHLWRRAASATLDGGRAGDSSGPSAPAPAPASAPEPASAPVPSPPSPPCGPGLWRPW

SEQ ID NO: 15072 - protein, 186 aa, Homo Sapiens
MEKKRRARINVSLEQLKSLLEKHYSHQIRKRKLEKADILELSVKYMRSLQNSLQGLWPVPRGAEQPSGFRSCLPGVSQLLRRGDEVGSGLRCPLVPESAAGSTMDSAGLGQEAPALFRPCTPAVWAPAPAAGGPRSPPPLLLLPESLPGSSASVPPPQPASSRCAESPGLGLRVWRPWGSPGDDLN

SEQ ID NO: 15073 - protein, 221 aa, Homo Sapiens
MAADTPGKPSASPMAGAPASASRTPDKPRSAAEHRKSSKPVMEKRRRARINESLAQLKTLILDALRKESSRHSKLEKADILEMTVRHLRSLRRVQVTAALSADPAVLGKYRAGFHECLAEVNRFLAGCEGVPADVRSRLLGHLAACLRQLGPSRRPASLSPAAPAEAPAPEVYAGRPLLPSLGGPFPLLAPPLLPGLTRALPAAPRAGPQGPGGPWRPWLR

SEQ ID NO: 15074 - protein, 166 aa, Homo Sapiens
MAPSTVAVELLSPKEKNRLRKPVVEKMRRDRINSSIEQLKLLLEQEFARHQPNSKLEKADILEMAVSYLKHSKAFVAAAGPKSLHQDYSEGYSWCLQEAVQFLTLHAASDTQMKLLYHFQRPPAAPAAPAKEPKAPGAAPPPALSAKATAAAAAAHQPACGLWRPW

SEQ ID NO: 15075 - protein, 224 aa, Homo Sapiens
MAPPAAPGRDRVGREDEDGWETRGDRKARKPLVEKKRRARINESLQELRLLLAGAEVQAKLENAEVLELTVRRVQGVLRGRAREREQLQAEASERFAAGYIQCMHEVHTFVSTCQAIDATVAAELLNHLLESMPLREGSSFQDLLGDALAGPPRAPGRSGWPAGGAPGSPIPSPPGPGDDLCSDLEEAPEAELSQAPAEGPDLVPAALGSLTTAQIARSVWRPW

SEQ ID NO: 15076 - protein, 225 aa, Homo Sapiens
MVTRDRAENRDGPKMLKPLVEKRRRDRINRSLEELRLLLLERTRDQNLRNPKLEKAEILEFAVGYLRERSRVEPPGVPRSPVQDAEALASCYLSGFRECLLRLAAFAHDASPAARAQLFSALHGYLRPKPPRPKPVDPRPPAPRPSLDPAAPALGPALHQRPPVHQGHPSPRCAWSPSLCSPRAGDSGAPAPLTGLLPPPPPPHRQDGAPKAPLPPPPAFWRPWP

SEQ ID NO: 15077 - protein, 185 aa, Homo Sapiens
MSPSLQEGAQLGENKPSTCSFSIERILGLDQKKDCVPLMKPHRPWADTCSSSGKDGNLCLHVPNPPSGISFPSVVDHPMPEERASKYENYFSASERLSLKRELSWYRGRRPRTAFTQNQIEVLENVFRVNCYPGIDIREDLAQKLNLEEDRIQIWFQNRRAKLKRSHRESQFLMAKKNFNTNLLE

SEQ ID NO: 15078 - protein, 304 aa, Homo Sapiens
MKRAHPEYSSSDSELDETIEVEKESADENGNLSSALGSMSPTTSSQILARKRRRGIIEKRRRDRINNSLSELRRLVPSAFEKQGSAKLEKAEILQMTVDHLKMLHTAGGKGYFDAHALAMDYRSLGFRECLAEVARYLSIIEGLDASDPLRVRLVSHLNNYASQREAASGAHAGLGHIPWGTVFGHHPHIAHPLLLPQNGHGNAGTTASPTEPHHQGRLGSAHPEAPALRAPPSGSLGPVLPVVTSASKLSPPLLSSVASLSAFPFSFGSFHLLSPNALSPSAPTQAANLGKPYRPWGTEIGAF

SEQ ID NO: 15079 - protein, 337 aa, Homo Sapiens
MKRPCEETTSESDMDETIDVGSENNYSGQSTSSVIRLNSPTTTSQIMARKKRRGIIEKRRRDRINNSLSELRRLVPTAFEKQGSAKLEKAEILQMTVDHLKMLQATGGKGYFDAHALAMDFMSIGFRECLTEVARYLSSVEGLDSSDPLRVRLVSHLSTCATQREAAAMTSSMAHHHHPLHPHHWAAAFHHLPAALLQPNGLHASESTPCRLSTTSEVPPAHGSALLTATFAHADSALRMPSTGSVAPCVPPLSTSLLSLSATVHAAAAAATAAAHSFPLSFAGAFPMLPPNAAAAVAAATAISPPLSVSATSSPQQTSSGTNNKPYRPWGTEVGAF

SEQ ID NO: 15080 - protein, 328 aa, Homo Sapiens
MKRPKEPSGSDGESDGPIDVGQEGQLSQMARPLSTPSSSQMQARKKHRGIIEKRRRDRINSSLSELRRLVPTAFEKQGSSKLEKAEVLQMTVDHLKMLHATGGTGFFDARALAVDFRSIGFRECLTEVIRYLGVLEGPSSRADPVRIRLLSHLNSYAAEMEPSPTPTGPLAFPAWPWSFFHSCPGLPALSNQLAILGRVPSPVLPGVSSPAYPIPALRTAPLRRATGIILPARRNVLPSRGASSTRRARPLERPATPVPVAPSSRAARSSHIAPLLQSSSPTPPGPTGSAAYVAVPTPNSSSPGPAGRPAGAMLYHSWVSEITEIGAF

SEQ ID NO: 15081 - protein, 270 aa, Homo Sapiens
MQYPHPGPAAGAVGVPLYAPTPLLQPAHPTPFYIEDILGRGPAAPTPAPTLPSPNSSFTSLVSPYRTPVYEPTPIHPAFSHHSAAALAAAYGPGGFGGPLYPFPRTVNDYTHALLRHDPLGKPLLWSPFLQRPLHKRKGGQVRFSNDQTIELEKKFETQKYLSPPERKRLAKMLQLSERQVKTWFQNRRAKWRRLKQENPQSNKKEELESLDSSCDQRQDLPSEQNKGASLDSSQCSPSPASQEDLESEISEDSDQEVDIEGDKSYFNAG

SEQ ID NO: 15082 - protein, 733 aa, Homo Sapiens
MTFPEADILLKSGECAGQTMLDTMEAPGHSRQLLLQLNNQRTKGFLCDVIIVVQNALFRAHKNVLAASSAYLKSLVVHDNLLNLDHDMVSPAVFRLVLDFIYTGRLADGAEAAAAAAVAPGAEPSLGAVLAAASYLQIPDLVALCKKRLKRHGKYCHLRGGGGGGGGYAPYGRPGRGLRAATPVIQACYPSPVGPPPPPAAEPPSGPEAAVNTHCAELYASGPGPAAALCASERRCSPLCGLDLSKKSPPGSAAPERPLAERELPPRPDSPPSAGPAAYKEPPLALPSLPPLPFQKLEEAAPPSDPFRGGSGSPGPEPPGRPDGPSLLYRWMKHEPGLGSYGDELGRERGSPSERCEERGGDAAVSPGGPPLGLAPPPRYPGSLDGPGAGGDGDDYKSSSEETGSSEDPSPPGGHLEGYPCPHLAYGEPESFGDNLYVCIPCGKGFPSSEQLNAHVEAHVEEEEALYGRAEAAEVAAGAAGLGPPFGGGGDKVAGAPGGLGELLRPYRCASCDKSYKDPATLRQHEKTHWLTRPYPCTICGKKFTQRGTMTRHMRSHLGLKPFACDACGMRFTRQYRLTEHMRIHSGEKPYECQVCGGKFAQQRNLISHMKMHAVGGAAGAAGALAGLGGLPGVPGPDGKGKLDFPEGVFAVARLTAEQLSLKQQDKAAAAELLAQTTHFLHDPKVALESLYPLAKFTAELGLSPDKAAEVLSQGAHLAAGPDGRTIDRFSPT

SEQ ID NO: 15083 - protein, 615 aa, Homo Sapiens
MVSGPLALRWCAWAGRGDMGPDMELPSHSKQLLLQLNQQRTKGFLCDVIIMVENSIFRAHKNVLAASSIYFKSLVLHDNLINLDTDMVSSTVFQQILDFIYTGKLLPSDQPAEPNFSTLLTAASYLQLPELAALCRRKLKRAGKPFGSGRAGSTGMGRPPRSQRLSTASVIQARYQGLVDGRKGAHAPQELPQAKGSDDELFLGGSNQDSVQGLGRAVCPAGGEAGLGGCSSSTNGSSGGCEQELGLDLSKKSPPLPPATPGPHLTPDDAAQLSDSQHGSPPAASAPPVANSASYSELGGTPDEPMDLEGAEDNHLSLLEAPGGQPRKSLRHSTRKKEWGKKEPVAGSPFERREAGPKGPCPGEEGEGVGDRVPNGILASGAGPSGPYGEPPYPCKEEEENGKDASEDSAQSGSEGGSGHASAHYMYRQEGYETVSYGDNLYVCIPCAKGFPSSEQLNAHVETHTEEELFIKEEGAYETGSGGAEEEAEDLSAPSAAYTAEPRPFKCSVCEKTYKDPATLRQHEKTHWLTRPFPCNICGKMFTQRGTMTRHMRSHLGLKPFACDECGMRFTRQYRLTEHMRVHSGEKPYECQLCGGKFTQQRNLISHLRMHTSPS

SEQ ID NO: 15084 - protein, 826 aa, Homo Sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 15085 - protein, 669 aa, Homo Sapiens
MALGLQRARSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGLGPSLLSPYSDEDTTQPGGPFQPRAGSAQAD

SEQ ID NO: 15086 - protein, 517 aa, Homo Sapiens
MPPPGKVPRKENLWLQCEWGSCSFVCSTMEKFFEHVTQHLQQHLHGSGEEEEEEEEDDPLEEEFSCLWQECGFCSLDSSADLIRHVYFHCYHTKLKQWGLQALQSQADLGPCILDFQSRNVIPDIPDHFLCLWEHCENSFDNPEWFYRHVEAHSLCCEYEAVGKDNPVVLCGWKGCTCTFKDRSKLREHLRSHTQEKVVACPTCGGMFANNTKFLDHIRRQTSLDQQHFQCSHCSKRFATERLLRDHMRNHVNHYKCPLCDMTCPLPSSLRNHMRFRHSEDRPFKCDCCDYSCKNLIDLQKHLDTHSEEPAYRCDFENCTFSARSLCSIKSHYRKVHEGDSEPRYKCHVCDKCFTRGNNLTVHLRKKHQFKWPSGHPRFRYKEHEDGYMRLQLVRYESVELTQQLLRQPQEGSGLGTSLNESSLQGIILETVPGEPGRKEEEEEGKGSEGTALSASQDNPSSVIHVVNQTNAQGQQEIVYYVLSEAPGEPPPAPEPPSGGIMEKLQGIAEEPEIQMV

SEQ ID NO: 15087 - protein, 2718 aa, Homo Sapiens
MPRTKQIHPRNLRDKIEEAQKELNGAEVSKKEILQAGVKGTSESLKGVKRKKIVAENHLKKIPKSPLRNPLQAKHKQNTEESSFAVLHSASESHKKQNYIPVKNGKQFTKQNGETPGIIAEASKSEESVSPKKPLFLQQPSELRRWRSEGADPAKFSDLDEQCDSSSLSSKTRTDNSECISSHCGTTSPSYTNTAFDVLLKAMEPELSTLSQKGSPCAIKTEKLRPNKTARSPPKLKNSSMDAPNQTSQELVAESQSSCTSYTVHMSAAQKNEQGAMQSASHLYHQHEHFVPKSNQHNQQLPGCSGFTGSLTNLQNQENAKLEQVYNIAVTSSVGLTSPSSRSQVTPQNQQMDSASPLSISPANSTQSPPMPIYNSTHVASVVNQSVEQMCNLLLKDQKPKKQGKYICEYCNRACAKPSVLLKHIRSHTGERPYPCVTCGFSFKTKSNLYKHKKSHAHTIKLGLVLQPDAGGLFLSHESPKALSIHSDVEDSGESEEEGATDERQHDLGAMELQPVHIIKRMSNAETLLKSSFTPSSPENVIGDFLLQDRSAESQAVTELPKVVVHHVTVSPLRTDSPKAMDPKPELSSAQKQKDLQVTNVQPLSANMSQGGVSRLETNENSHQKGDMNPLEGKQDSHVGTVHAQLQRQQATDYSQEQQGKLLSPRSLGSTDSGYFSRSESADQTVSPPTPFARRLPSTEQDSGRSNGPSAALVTTSTPSALPTGEKALLLPGQMRPPLATKTLEERISKLISDNEALVDDKQLDSVKPRRTSLSRRGSIDSPKSYIFKDSFQFDLKPVGRRTSSSSDIPKSPFTPTEKSKQVFLLSVPSLDCLPITRSNSMPTTGYSAVPANIIPPPHPLRGSQSFDDKIGTFYDDVFVSGPNAPVPQSGHPRTLVRQAAIEDSSANESHVLGTGQSLDESHQGCHAAGEAMSVRSKALAQGPHIEKKKSHQGRGTMFECETCRNRYRKLENFENHKKFYCSELHGPKTKVAMREPEHSPVPGGLQPQILHYRVAGSSGIWEQTPQIRKRRKMKSVGDDEELQQNESGTSPKSSEGLQFQNALGCNPSLPKHNVTIRSDQQHKNIQLQNSHIHLVARGPEQTMDPKLSTIMEQQISSAAQDKIELQRHGTGISVIQHTNSLSRPNSFDKPEPFERASPVSFQELNRTGKSGSLKVIGISQEESHPSRDGSHPHQLALSDALRGELQESSRKSPSERHVLGQPSRLVRQHNIQVPEILVTEEPDRDLEAQCHDQEKSEKFSWPQRSETLSKLPTEKLPPKKKRLRLAEIEHSSTESSFDSTLSRSLSRESSLSHTSSFSASLDIEDVSKTEASPKIDFLNKAEFLMIPAGLNTLNVPGCHREMRRTASEQINCTQTSMEVSDLRSKSFDCGSITPPQTTPLTELQPPSSPSRVGVTGHVPLLERRRGPLVRQISLNIAPDSHLSPVHPTSFQNTALPSVNAVPYQGPQLTSTSLAEFSANTLHSQTQVKDLQAETSNSSSTNVFPVQQLCDINLLNQIHAPPSHQSTQLSLQVSTQGSKPDKNSVLSGSSKSEDCFAPKYQLHCQVFTSGPSCSSNPVHSLPNQVISDPVGTDHCVTSATLPTKLIDSMSNSHPLLPPELRPLGSQVQKVPSSFMLPIRLQSSVPAYCFATLTSLPQILVTQDLPNQPICQTNHSVVPISEEQNSVPTLQKGHQNALPNPEKEFLCENVFSEMSQNSSLSESLPITQKISVGRLSPQQESSASSKRMLSPANSLDIAMEKHQKRAKDENGAVCATDVRPLEALSSRVNEASKQKKPILVRQVCTTEPLDGVMLEKDVFSQPEISNEAVNLTNVLPADNSSTGCSKFVVIEPISELQEFENIKSSTSLTLTVRSSPAPSENTHISPLKCTDNNQERKSPGVKNQGDKVNIQEQSQQPVTSLSLFNIKDTQQLAFPSLKTTTNFTWCYLLRQKSLHLPQKDQKTSAYTDWTVSASNPNPLGLPTKVALALLNSKQNTGKSLYCQAITTHSKSDLLVYSSKWKSSLSKRALGNQKSTVVEFSNKDASEINSEQDKENSLIKSEPRRIKIFDGGYKSNEEYVYVRGRGRGKYICEECGIRCKKPSMLKKHIRTHTDVRPYHCTYCNFSFKTKGNLTKHMKSKAHSKKCVDLGVSVGLIDEQDTEESDEKQRFSYERSGYDLEESDGPDEDDNENEDDDEDSQAESVLSATPSVTASPQHLPSRSSLQDPVSTDEDVRITDCFSGVHTDPMDVLPRALLTRMTVLSTAQSDYNRKTLSPGKARQRAARDENDTIPSVDTSRSPCHQMSVDYPESEEILRSSMAGKAVAITQSPSSVRLPPAAAEHSPQTAAGMPSVASPHPDPQEQKQQITLQPTPGLPSPHTHLFSHLPLHSQQQSRTPYNMVPVGGIHVVPAGLTYSTFVPLQAGPVQLTIPAVSVVHRTLGTHRNTVTEVSGTTNPAGVAELSSVVPCIPIGQIRVPGLQNLSTPGLQSLPSLSMETVNIVGLANTNMAPQVHPPGLALNAVGLQVLTANPSSQSSPAPQAHIPGLQILNIALPTLIPSVSQVAVDAQGAPEMPASQSKACETQPKQTSVASANQVSRTESPQGLPTVQRENAKKVLNPPAPAGDHARLDGLSKMDTEKAASANHVKPKPELTSIQGQPASTSQPLLKAHSEVFTKPSGQQTLSPDRQVPRPTALPRRQPTVHFSDVSSDDDEDRLVIAT

SEQ ID NO: 15088 - protein, 2446 aa, Homo Sapiens
MDTGDTALGQKATSRSGETDKASGRWRQEQSAVIKMSTFGSHEGQRQPQIEPEQIGNTASAQLFGSGKLASPSEVVQQVAEKQYPPHRPSPYSCQHSLSFPQHSLPQGVMHSTKPHQSLEGPPWLFPGPLPSVASEDLFPFPIHGHSGGYPRKKISSLNPAYSQYSQKSIEQAEEAHKKEHKPKKPGKYICPYCSRACAKPSVLKKHIRSHTGERPYPCIPCGFSFKTKSNLYKHRKSHAHAIKAGLVPFTESAVSKLDLEAGFIDVEAEIHSDGEQSTDTDEESSLFAEASDKMSPGPPIPLDIASRGGYHGSLEESLGGPMKVPILIIPKSGIPLPNESSQYIGPDMLPNPSLNTKADDSHTVKQKLALRLSEKKGQDSEPSLNLLSPHSKGSTDSGYFSRSESAEQQISPPNTNAKSYEEIIFGKYCRLSPRNALSVTTTSQERAAMGRKGIMEPLPHVNTRLDVKMFEDPVSQLIPSKGDVDPSQTSMLKSTKFNSESRQPQIIPSSIRNEGKLYPANFQGSNPVLLEAPVDSSPLIRSNSVPTSSATNLTIPPSLRGSHSFDERMTGSDDVFYPGTVGIPPQRMLRRQAAFELPSVQEGHVEVEHHGRMLKGISSSSLKEKKLSPGDRVGYDYDVCRKPYKKWEDSETPKQNYRDISCLSSLKHGGEYFMDPVVPLQGVPSMFGTTCENRKRRKEKSVGDEEDTPMICSSIVSTPVGIMASDYDPKLQMQEGVRSGFAMAGHENLSHGHTERFDPCRPQLQPGSPSLVSEESPSAIDSDKMSDLGGRKPPGNVISVIQHTNSLSRPNSFERSESAELVACTQDKAPSPSETCDSEISEAPVSPEWAPPGDGAESGGKPSPSQQVQQQSYHTQPRLVRQHNIQVPEIRVTEEPDKPEKEKEAQSKEPEKPVEEFQWPQRSETLSQLPAEKLPPKKKRLRLADMEHSSGESSFESTGTGLSRSPSQESNLSHSSSFSMSFEREETSKLSALPKQDEFGKHSEFLTVPAGSYSLSVPGHHHQKEMRRCSSEQMPCPHPAEVPEVRSKSFDYGNLSHAPVSGAAASTVSPSRERKKCFLVRQASFSGSPEISQGEVGMDQSVKQEQLEHLHAGLRSGWHHGPPAVLPPLQQEDPGKQVAGPCPPLSSGPLHLAQPQIMHMDSQESLRNPLIQPTSYMTSKHLPEQPHLFPHQETIPFSPIQNALFQFQYPTVCMVHLPAQQPPWWQAHFPHPFAQHPQKSYGKPSFQTEIHSSYPLEHVAEHTGKKPAEYAHTKEQTYPCYSGASGLHPKNLLPKFPSDQSSKSTETPSEQVLQEDFASANAGSLQSLPGTVVPVRIQTHVPSYGSVMYTSISQILGQNSPAIVICKVDENMTQRTLVTNAAMQGIGFNIAQVLGQHAGLEKYPIWKAPQTLPLGLESSIPLCLPSTSDSVATLGGSKRMLSPASSLELFMETKQQKRVKEEKMYGQIVEELSAVELTNSDIKKDLSRPQKPQLVRQGCASEPKDGLQSGSSSFSSLSPSSSQDYPSVSPSSREPFLPSKEMLSGSRAPLPGQKSSGPSESKESSDELDIDETASDMSMSPQSSSLPAGDGQLEEEGKGHKRPVGMLVRMASAPSGNVADSTLLLTDMADFQQILQFPSLRTTTTVSWCFLNYTKPNYVQQATFKSSVYASWCISSCNPNPSGLNTKTTLALLRSKQKITAEIYTLAAMHRPGTGKLTSSSAWKQFTQMKPDASFLFGSKLERKLVGNILKERGKGDIHGDKDIGSKQTEPIRIKIFEGGYKSNEDYVYVRGRGRGKYICEECGIRCKKPSMLKKHIRTHTDVRPYVCKLCNFAFKTKGNLTKHMKSKAHMKKCLELGVSMTSVDDTETEEAENLEDLHKAAEKHSMSSISTDHQFSDAEESDGEDGDDNDDDDEDEDDFDDQGDLTPKTRSRSTSPQPPRFSSLPVNVGAVPHGVPSDSSLGHSSLISYLVTLPSIRVTQLMTPSDSCEDTQMTEYQRLFQSKSTDSEPDKDRLDIPSCMDEECMLPSEPSSSPRDFSPSSHHSSPGYDSSPCRDNSPKRYLIPKGDLSPRRHLSPRRDLSPMRHLSPRKEAALRREMSQRDVSPRRHLSPRRPVSPGKDITARRDLSPRRERRYMTTIRAPSPRRALYHNPPLSMGQYLQAEPIVLGPPNLRRGLPQVPYFSLYGDQEGAYEHPGSSLFPEGPNDYVFSHLPLHSQQQVRAPIPMVPVGGIQMVHSMPPALSSLHPSPTLPLPMEGFEEKKGASGESFSKDPYVLSKQHEKRGPHALQSSGPPSTPSSPRLLMKQSTSEDSLNATEREQEENIQTCTKAIASLRIATEEAALLGPDQPARVQEPHQNPLGSAHVSIRHFSRPEPGQPCTSATHPDLHDGEKDNFGTSQTPLAHSTFYSKSCVDDKQLDFHSSKELSSSTEESKDPSSEKSQLH

SEQ ID NO: 15089 - protein, 2406 aa, Homo Sapiens
MDPEQSVKGTKKAEGSPRKRLTKGEAIQTSVSSSVPYPGSGTAATQESPAQELLAPQPFPGPSSVLREGSQEKTGQQQKPPKRPPIEASVHISQLPQHPLTPAFMSPGKPEHLLEGSTWQLVDPMRPGPSGSFVAPGLHPQSQLLPSHASIIPPEDLPGVPKVFVPRPSQVSLKPTEEAHKKERKPQKPGKYICQYCSRPCAKPSVLQKHIRSHTGERPYPCGPCGFSFKTKSNLYKHRKSHAHRIKAGLASGMGGEMYPHGLEMERIPGEEFEEPTEGESTDSEEETSATSGHPAELSPRPKQPLLSSGLYSSGSHSSSHERCSLSQSSTAQSLEDPPPFVEPSSEHPLSHKPEDTHTIKQKLALRLSERKKVIDEQAFLSPGSKGSTESGYFSRSESAEQQVSPPNTNAKSYAEIIFGKCGRIGQRTAMLTATSTQPLLPLSTEDKPSLVPLSVPRTQVIEHITKLITINEAVVDTSEIDSVKPRRSSLSRRSSMESPKSSLYREPLSSHSEKTKPEQSLLSLQHPPSTAPPVPLLRSHSMPSAACTISTPHHPFRGSYSFDDHITDSEALSHSSHVFTSHPRMLKRQPAIELPLGGEYSSEEPGPSSKDTASKPSDEVEPKESELTKKTKKGLKTKGVIYECNICGARYKKRDNYEAHKKYYCSELQIAKPISAGTHTSPEAEKSQIEHEPWSQMMHYKLGTTLELTPLRKRRKEKSLGDEEEPPAFESTKSQFGSPGPSDAARNLPLESTKSPAEPSKSVPSLEGPTGFQPRTPKPGSGSESGKERRTTSKEISVIQHTSSFEKSDSLEQPSGLEGEDKPLAQFPSPPPAPHGRSAHSLQPKLVRQPNIQVPEILVTEEPDRPDTEPEPPPKEPEKTEEFQWPQRSQTLAQLPAEKLPPKKKRLRLAEMAQSSGESSFESSVPLSRSPSQESNVSLSGSSRSASFERDDHGKAEAPSPSSDMRPKPLGTHMLTVPSHHPHAREMRRSASEQSPNVSHSAHMTETRSKSFDYGSLSLTGPSAPAPVAPPARVAPPERRKCFLVRQASLSRPPESELEVAPKGRQESEEPQPSSSKPSAKSSLSQISSAATSHGGPPGGKGPGQDRPPLGPTVPYTEALQVFHHPVAQTPLHEKPYLPPPVSLFSFQHLVQHEPGQSPEFFSTQAMSSLLSSPYSMPPLPPSLFQAPPLPLQPTVLHPGQLHLPQLMPHPANIPFRQPPSFLPMPYPTSSALSSGFFLPLQSQFALQLPGDVESHLPQIKTSLAPLATGSAGLSPSTEYSSDIRLPPVAPPASSSAPTSAPPLALPACPDTMVSLVVPVRVQTNMPSYGSAMYTTLSQILVTQSQGSSATVALPKFEEPPSKGTTVCGADVHEVGPGPSGLSEEQSRAFPTPYLRVPVTLPERKGTSLSSESILSLEGSSSTAGGSKRVLSPAGSLELTMETQQQKRVKEEEASKADEKLELVKPCSVVLTSTEDGKRPEKSHLGNQGQGRRELEMLSSLSSDPSDTKEIPPLPHPALSHGTAPGSEALKEYPQPSGKPHRRGLTPLSVKKEDSKEQPDLPSLAPPSSLPLSETSSRPAKSQEGTDSKKVLQFPSLHTTTNVSWCYLNYIKPNHIQHADRRSSVYAGWCISLYNPNLPGVSTKAALSLLRSKQKVSKETYTMATAPHPEAGRLVPSSSRKPRMTEVHLPSLVSPEGQKDLARVEKEEERRGEPEEDAPASQRGEPARIKIFEGGYKSNEEYVYVRGRGRGKYVCEECGIRCKKPSMLKKHIRTHTDVRPYVCKHCHFAFKTKGNLTKHMKSKAHSKKCQETGVLEELEAEEGTSDDLFQDSEGREGSEAVEEHQFSDLEDSDSDSDLDEDEDEDEEESQDELSRPSSEAPPPGPPHALRADSSPILGPQPPDAPASGTEATRGSSVSEAERLTASSCSMSSQSMPGLPWLGPAPLGSVEKDTGSALSYKPVSPRRPWSPSKEAGSRPPLARKHSLTKNDSSPQRCSPAREPQASAPSPPGLHVDPGRGMGALPCGSPRLQLSPLTLCPLGRELAPRAHVLSKLEGTTDPGLPRYSPTRRWSPGQAESPPRSAPPGKWALAGPGSPSAGEHGPGLGLDPRVLFPPAPLPHKLLSRSPETCASPWQKAESRSPSCSPGPAHPLSSRPFSALHDFHGHILARTEENIFSHLPLHSQHLTRAPCPLIPIGGIQMVQARPGAHPTLLPGPTAAWVSGFSGGGSDLTGAREAQERGRWSPTESSSASVSPVAKVSKFTLSSELEGGDYPKERERTGGGPGRPPDWTPHGTGAPAEPTPTHSPCTPPDTLPRPPQGRRAAQSWSPRLESPRAPTNPEPSATPPLDRSSSVGCLAEASARFPARTRNLSGEPRTRQDSPKPSGSGEPRAHPHQPEDRVPPNA

SEQ ID NO: 15090 - protein, 659 aa, Homo Sapiens
MRVNHTVSTMLPTCMVHRQTMSCSGAGGITAFVAFRDVAVYFTQEEWRLLSPAQRTLHREVMLETYNHLVSLEIPSSKPKLIAQLERGEAPWREERKCPLDLCPESKPEIQLSPSCPLIFSSQQALSQHVWLSHLSQLFSSLWAGNPLHLGKHYPEDQKQQQDPFCFSGKAEWIQEGEDSRLLFGRVSKNGTSKALSSPPEEQQPAQSKEDNTVVDIGSSPERRADLEETDKVLHGLEVSGFGEIKYEEFGPGFIKESNLLSLQKTQTGETPYMYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 15091 - protein, 295 aa, Homo Sapiens
MEKMSRPLPLNPTFIPPPYGVLRSLLENPLKLPLHHEDAFSKDKDKEKKLDDESNSPTVPQSAFLGPTLWDKTLPYDGDTFQLEYMDLEEFLSENGIPPSPSQHDHSPHPPGLQPASSAAPSVMDLSSRASAPLHPGIPSPNCMQSPIRPGQLLPANRNTPSPIDPDTIQVPVGYEPDPADLALSSIPGQEMFDPRKRKFSEEELKPQPMIKKARKVFIPDDLKDDKYWARRRKNNMAAKRSRDARRLKENQIAIRASFLEKENSALRQEVADLRKELGKCKNILAKYEARHGPL

SEQ ID NO: 15092 - protein, 1009 aa, Homo Sapiens
MSWMFKRDPVWKYLQTVQYGVHGNFPRLSYPTFFPRFEFQDVIPPDDFLTSDEEVDSVLFGSLRGHVVGLRYYTGVVNNNEMVALQRDPNNPYDKNAIKVNNVNGNQVGHLKKELAGALAYIMDNKLAQIEGVVPFGANNAFTMPLHMTFWGKEENRKAVSDQLKKHGFKLGPAPKTLGFNLESGWGSGRAGPSYSMPVHAAVQMTTEQLKTEFDKLFEDLKEDDKTHEMEPAEAIETPLLPHQKQALAWMVSRENSKELPPFWEQRNDLYYNTITNFSEKDRPENVHGGILADDMGLGKTLTAIAVILTNFHDGRPLPIERVKKNLLKKEYNVNDDSMKLGGNNTSEKADGLSKDASRCSEQPSISDIKEKSKFRMSELSSSRPKRRKTAVQYIESSDSEEIETSELPQKMKGKLKNVQSETKGRAKAGSSKVIEDVAFACALTSSVPTTKKKMLKKGACAVEGSKKTDVEERPRTTLIICPLSVLSNWIDQFGQHIKSDVHLNFYVYYGPDRIREPALLSKQDIVLTTYNILTHDYGTKGDSPLHSIRWLRVILDEGHAIRNPNAQQTKAVLDLESERRWVLTGTPIQNSLKDLWSLLSFLKLKPFIDREWWHRTIQRPVTMGDEGGLRRLQSLIKNITLRRTKTSKIKGKPVLELPERKVFIQHITLSDEERKIYQSVKNEGRATIGRYFNEGTVLAHYADVLGLLLRLRQICCHTYLLTNAVSSNGPSGNDTPEELRKKLIRKMKLILSSGSDEECAICLDSLTVPVITHCAHVFCKPCICQVIQNEQPHAKCPLCRNDIHEDNLLECPPEELARDSEKKSDMEWTSSSKINALMHALTDLRKKNPNIKSLVVSQFTTFLSLIEIPLKASGFVFTRLDGSMAQKKRVESIQCFQNTEAGSPTIMLLSLKAGGVGLNLSAASRVFLMDPAWNPAAEDQCFDRCHRLGQKQEVIITKFIVKDSVEENMLKIQNKKRELAAGAFGTKKPNADEMKQAKINEIRTLIDL

SEQ ID NO: 15093 - protein, 488 aa, Homo Sapiens
MFAAGLAPFYASNFSLWSAAYCSSAGPGGCSFPLDPAAVKKPSFCIADILHAGVGDLGAAPEGLAGASAAALTAHLGSVHPHASFQAAARSPLRPTPVVAPSEVPAGFPQRLSPLSAAYHHHHPQQQQQQQQPQQQQPPPPPRAGALQPPASGTRVVPNPHHSGSAPAPSSKDLKFGIDRILSAEFDPKVKEGNTLRDLTSLLTGGRPAGVHLSGLQPSAGQFFASLDPINEASAILSPLNSNPRNSVQHQFQDTFPGPYAVLTKDTMPQTYKRKRSWSRAVFSNLQRKGLEKRFEIQKYVTKPDRKQLAAMLGLTDAQVKVWFQNRRMKWRHSKEAQAQKDKDKEAGEKPSGGAPAADGEQDERSPSRSEGEAESESSDSESLDMAPSDTERTEGSERSLHQTTVIKAPVTGALITASSAGSGGSSGGGGNSFSFSSASSLSSSSTSAGCASSLGGGGASELLPATQPTASSAPKSPEPAQGALGCL

SEQ ID NO: 15094 - protein, 420 aa, Homo Sapiens
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPGKKLSDLERVTSLKVYNWFANRRKEIKRRANIEAAILESHGIDVQSPGGHSNSDDVDGNDYSEQDDSTSHSDHQDPISLAVEMAAVNHTILALARQGANEIKTEALDDD

SEQ ID NO: 15095 - protein, 347 aa, Homo Sapiens
MENLMTSSTLPPLFADEDGSKESNDLATTGLNHPEVPYSSGATSSTNNPEFVEDLSQGQLLQSESSNAAEGNEQRHEDEQRSKRGGWSKGRKRKKPLRDSNAPKSPLTGYVRFMNERREQLRAKRPEVPFPEITRMLGNEWSKLPPEEKQRYLDEADRDKERYMKELEQYQKTEAYKVFSRKTQDRQKGKSHRQDAARQATHDHEKETEVKERSVFDIPIFTEEFLNHSKAREAELRQLRKSNMEFEERNAALQKHVESMRTAVEKLEVDVIQERSRNTVLQQHLETLRQVLTSSFASMPLPGSGETPTVDTIDSYMNRLHSIILANPQDNENFIATVREVVNRLDR

SEQ ID NO: 15096 - protein, 317 aa, Homo Sapiens
MSHGPKQPGAAAAPAGGKAPGQHGGFVVTVKQERGEGPRAGEKGSHEEEPVKKRGWPKGKKRKKILPNGPKAPVTGYVRFLNERREQIRTRHPDLPFPEITKMLGAEWSKLQPTEKQRYLDEAEREKQQYMKELRAYQQSEAYKMCTEKIQEKKIKKEDSSSGLMNTLLNGHKGGDCDGFSTFDVPIFTEEFLDQNKAREAELRRLRKMNVAFEEQNAVLQRHTQSMSSARERLEQELALEERRTLALQQQLQAVRQALTASFASLPVPGTGETPTLGTLDFYMARLHGAIERDPAQHEKLIVRIKEILAQVASEHL

SEQ ID NO: 15097 - protein, 107 aa, Homo Sapiens
MSESSSKSSQPLASKQEKDGTEKRGRGRPRKQPPVSPGTALVGSQKEPSEVPTPKRPRGRPKGSKNKGAAKTRKTTTTPGRKPRGRPKKLEKEEEEGISQESSEEEQ

SEQ ID NO: 15098 - protein, 109 aa, Homo Sapiens
MSARGEGAGQPSTSAQGQPAAPAPQKRGRGRPRKQQQEPTGEPSPKRPRGRPKGSKNKSPSKAAQKKAEATGEKRPRGRPRKWPQQVVQKKPAQEETEETSSQESAEED

SEQ ID NO: 15099 - protein, 1538 aa, Homo Sapiens
MQRTQPRPCYLNAPQQCPGAERPGRPTAGSHSFLLRPGPLAGSSPFALLDPLQAFEQFVWVRSQARAGLLRLRQGSHAVTRCRPLPVRREGRRDGSPWRSVVCRYCRCSRQTGASVTTVSLPSSSSSPGLDPRGPRQASVRSLRSEPVLLFLPFRTPYRDSEEGKREGLSRLRAVCRRAGPRGRGSFSPRDARASPRLHFLVAAVTTGAASRRQRGARVRQPSPSSSRRAKRLRECERRSLHAPPAMDASYDGTEVTVVMEEIEEAYCYTSPGPPKKKKKYKIHGEKTKKPRSAYLLYYYDIYLKVQQELPHLPQSEINKKISESWRLLSVAERSYYLEKAKLEKEGLDPNSKLSALTAVVPDIPGFRKILPRSDYIIIPKSSLQEDRSCPQLELCVAQNQMSPKGPPLVSNTAPETVPSHAGMAEQCLAVEALAEEVGALTQSGAVQEIATSEILSQDVLLEDASLEVGESHQPYQTSLVIEETLVNGSPDLPTGSLAVPHPQVGESVSVVTVMRDSSESSSSAPATQFIMLPLPAYSVVENPTSIKLTTTYTRRGHGTCTSPGCSFTYVTRHKPPKCPTCGNFLGGKWIPKEKPAKVKVELASGVSSKGSVVKRNQQPVTTEQNSSKENASKLTLENSEAVSQLLNVAPPREVGEESEWEEVIISDAHVLVKEAPGNCGTAVTKTPVVKSGVQPEVTLGTTDNDSPGADVPTPSEGTSTSSPLPAPKKPTGADLLTPGSRAPELKGRARGKPSLLAAARPMRAILPAPVNVGRGSSMGLPRARQAFSLSDKTPSVRTCGLKPSTLKQLGQPIQQPSGPGEVKLPSGPSNRTSQVKVVEVKPDMFPPYKYSCTVTLDLGLATSRGRGKCKNPSCSYVYTNRHKPRICPSCGVNLAKDRTEKTTKAIEVSSPLPDVLNATEPLSTAQREIQRQSTLQLLRKVLQIPENESELAEVFALIHELNSSRLILSNVSEETVTIEQTSWSNYYESPSTQCLLCSSPLFKGGQNSLAGPQECWLLTASRLQTVTAQVKMCLNPHCLALHSFIDIYTGLFNVGNKLLVSLDLLFAIRNQIKLGEDPRVSINVVLKSVQEQTEKTLTSEELSQLQELLCNGYWAFECLTVRDYNDMICGICGVAPKVEMAQRSEENVLALKSVEFTWPEFLGSNEVNVEDFWATMETEVIEQVAFPASIPITKFDASVIAPFFPPLMRGAVVVNTEKDKNLDVQPVPGSGSALVRLLQEGTCKLDEIGSYSEEKLQHLLRQCGIPFGAEDSKDQLCFSLLALYESVQNGARAIRPPRHFTGGKIYKVCPHQVVCGSKYLVRGESARDHVDLLASSRHWPPVYVVDMATSVALCADLCYPELTNQMWGRNQGCFSSPTEPPVSVSCPELLDQHYTVDMTETEHSIQHPVTKTATRRIVHAGLQPNPGDPSAGHHSLALCPELAPYATILASIVDSKPNGVRQRPIAFDNATHYYLYNRLMDFLTSREIVNRQIHDIVQSCQPGEVVIRDTLYRLGVAQIKTETEEEGEEEEVAAVAE

SEQ ID NO: 15100 - protein, 601 aa, Homo Sapiens
MAYDDSVKKEDCFDGDHTFEDIGLAAGRSQREKKRSYKDFLREEEEIAAQVRNSSKKKLKDSELYFLGTDTHKKKRKHSSDDYYYGDISSLESSQKKKKKSSPQSTDTAMDLLKAITSPLAAGSKPSKKTGEKSSGSSSHSESKKEHHRKKVSGSSGELPLEDGGSHKSKKMKPLYVNTETLTLREPDGLKMKLILSPKEKGSSSVDEESFQYPSQQATVKKSSKKSARDEQGALLLGHELQSFLKTARKKHKSSSDAHSSPGPEGCGSDASQFAESHSANLDLSGLEPILVESDSSSGGELEAGELVIDDSYREIKKKKKSKKSKKKKDKEKHKEKRHSKSKRSLGLSAVPVGEVTVTSGPPPSIPYAGAAAPPLPLPGLHTDGHSEKKKKKEEKDKERERGEKPKKKNMSAYQVFCKEYRVTIVADHPGIDFGELSKKLAEVWKQLPEKDKLIWKQKAQYLQHKQNKAEATTVKRKASSSEGSMKVKASSVGVLSPQKKSPPTTMLLPASPAKAPETEPIDVAAHLQLLGESLSLIGHRLQETEGMVAVSGSLSVLLDSIICALGPLACLTTQLPELNGCPKQVLSNTLDNIAYIMPGL

SEQ ID NO: 15101 - protein, 348 aa, Homo Sapiens
MPDELTEPGRATPARASSFLIENLLAAEAKGAGRATQGDGSREDEEEDDDDPEDEDAEQARRRRLQRRRQLLAGTGPGGEARARALLGPGALGLGPRPPPGPGPPFALGCGGAARWYPRAHGGYGGGLSPDTSDRDSPETGEEMGRAEGAWPRGPGPGAVQREAAELAARGPAAGTEEASELAEVPAAAGETRGGVGVGGGRKKKTRTVFSRSQVFQLESTFDLKRYLSSAERAGLAASLQLTETQVKIWFQNRRNKWKRQLAAELEAASLSPPGAQRLVRVPVLYHESPPAAAAAGPPATLPFPLAPAAPAPPPPLLGFSGALAYPLAAFPAAASVPFLRAQMPGLV

SEQ ID NO: 15102 - protein, 273 aa, Homo Sapiens
MGSKEDAGKGCPAAGGVSSFTIQSILGGGPSEAPREPVGWPARKRSLSVSSEEEEPDDGWKAPACFCPDQHGPKEQGPKHHPPIPFPCLGTPKGSGGSGPGGLERTPFLSPSHSDFKEEKERLLPAGSPSPGSERPRDGGAERQAGAAKKKTRTVFSRSQVYQLESTFDMKRYLSSSERACLASSLQLTETQVKTWFQNRRNKWKRQLSAELEAANMAHASAQTLVSMPLVFRDSSLLRVPVPRSLAFPAPLYYPGSNLSALPLYNLYNKLDY

SEQ ID NO: 15103 - protein, 357 aa, Homo Sapiens
MPEPGPDAAGTASAQPQPPPPPPPAPKESPFSIKNLLNGDHHRPPPKPQPPPRTLFAPASAAAAAAAAAAAAAKGALEGAAGFALSQVGDLAFPRFEIPAQRFALPAHYLERSPAWWYPYTLTPAGGHLPRPEASEKALLRDSSPASGTDRDSPEPLLKADPDHKELDSKSPDEIILEESDSEESKKEGEAAPGAAGASVGAAAATPGAEDWKKGAESPEKKPACRKKKTRTVFSRSQVFQLESTFDMKRYLSSSERAGLAASLHLTETQVKIWFQNRRNKWKRQLAAELEAANLSHAAAQRIVRVPILYHENSAAEGAAAAAAGAPVPVSQPLLTFPHPVYYSHPVVSSVPLLRPV

SEQ ID NO: 15104 - protein, 1130 aa, Homo Sapiens
MAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNISLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 15105 - protein, 631 aa, Homo Sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQSPFMATMAQLQSPHALYSHKPEVAQYTHTGLLPQTMLITDTTNLSALASLTPTKQVFTSDTEASSESGLHTPASQATTLHVPSQDPAGIQHLQPAHRLSASPTVSSSSLVLYQSSDSSNGQSHLLPSNHSVIETFISTQMASSSQ

SEQ ID NO: 15106 - protein, 557 aa, Homo Sapiens
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFNQTVQSSGNMTDKSSQDQLLFLFPEFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGVRYSQQGNNEITSSSTISHHGNSAMVTSQSVLQQVSPASLDPGHNLLSPDGKMISVSGGGLPPVSTLTNIHSLSHHNPQQSQNLIMTPLSGVMAIAQSLNTSQAQSVPVINSVAGSLAALQPVQFSQQLHSPHQQPLMQQSPGSHMAQQPFMAAVTQLQNSHMYAHKQEPPQYSHTSRFPSAMVVTDTSSISTLTNMSSSKQCPLQAW

SEQ ID NO: 15107 - protein, 474 aa, Homo Sapiens
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 15108 - protein, 408 aa, Homo Sapiens
MNTTDNGVNCLCAICGDRATGKHYGASSCDGCKGFFRRSIRKSHVYSCRFSRQCVVDKDKRNQCRYCRLRKCFRAGMKKEAVQNERDRISTRRSTFDGSNIPSINTLAQAEVRSRQISVSSPGSSTDINVKKIASIGDVCESMKQQLLVLVEWAKYIPAFCELPLDDQVALLRAHAGEHLLLGATKRSMMYKDILLLGNNYVIHRNSCEVEISRVANRVLDELVRPFQEIQIDDNEYACLKAIVFFDPDAKGLSDPVKIKNMRFQVQIGLEDYINDRQYDSRGRFGELLLLLPTLQSITWQMIEQIQFVKLFGMVKIDNLLQEMLLGGASNDGSHLHHPMHPHLSQDPLTGQTILLGPMSTLVHADQISTPETPLPSPPQGSGQEQYKIAANQASVISHQHLSKQKQL

SEQ ID NO: 15109 - protein, 463 aa, Homo Sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNSVKQYSGKFF

SEQ ID NO: 15110 - protein, 550 aa, Homo Sapiens
MVRGWEPPPGLDCAISEGHKSEGTMPPNKEASGLSSSPAGLICLPPISEELQLVWTQAAQTSELDSNEHLLKTFSYFPYPSLADIALLCLRYGLQMEKVKTWFMAQRLRCGISWSSEEIEETRARVVYRRDQLHFKSLLSFTHHAGRPPEEVPPPPVPAPEQVGIGIGPPTLSKPTQTKGLKVEPEEPSQMPPLPQSHQKLKESLMTPGSGAFPYQSDFWQHLQSSGLSKEQAGRGPNQSHGIGTASWNHSTTVPQPQARDKPPPIALIASSCKEESASSVTPSSSSTSSSFQVLANGATAASKPLQPLGCVPQSVSPSEQALPPHLEPAWPQGLRHNSVPGRVGPTEYLSPDMQRQRKTKRKTKEQLAILKSFFLQCQWARREDYQKLEQITGLPRPEIIQWFGDTRYALKHGQLKWFRDNAVPGAPSFQDPAIPTPPPSTRSLNERAETPPLPIPPPPPDIQPLERYWAAHQQLRETDIPQLSQASRLSTQQVLDWFDSRLPQPAEVVVCLDEEEEEEEEELPEDDEEEEEEEEEDDDDDDDDVIIQD

SEQ ID NO: 15111 - protein, 73 aa, Homo Sapiens
MSAETASGPTEDQVEILEYNFNKVDKHPDSTTLCLIAAEAGLSEEETQKWFKQRLAKWRRSEGLPSECRSVTD

SEQ ID NO: 15112 - protein, 335 aa, Homo Sapiens
MDNARMNSFLEYPILSSGDSGTCSARAYPSDHRITTFQSCAVSANSCGGDDRFLVGRGVQIGSPHHHHHHHHHHPQPATYQTSGNLGVSYSHSSCGPSYGSQNFSAPYSPYALNQEADVSGGYPQCAPAVYSGNLSSPMVQHHHHHQGYAGGAVGSPQYIHHSYGQEHQSLALATYNNSLSPLHASHQEACRSPASETSSPAQTFDWMKVKRNPPKTGKVGEYGYLGQPNAVRTNFTTKQLTELEKEFHFNKYLTRARRVEIAASLQLNETQVKIWFQNRRMKQKKREKEGLLPISPATPPGNDEKAEESSEKSSSSPCVPSPGSSTSDTLTTSH

SEQ ID NO: 15113 - protein, 410 aa, Homo Sapiens
MSARKGYLLPSPNYPTTMSCSESPAANSFLVDSLISSGRGEAGGGGGGAGGGGGGGYYAHGGVYLPPAADLPYGLQSCGLFPTLGGKRNEAASPGSGGGGGGLGPGAHGYGPSPIDLWLDAPRSCRMEPPDGPPPPPQQQPPPPPQPPQPAPQATSCSFAQNIKEESSYCLYDSADKCPKVSATAAELAPFPRGPPPDGCALGTSSGVPVPGYFRLSQAYGTAKGYGSGGGGAQQLGAGPFPAQPPGRGFDLPPALASGSADAARKERALDSPPPPTLACGSGGGSQGDEEAHASSSAAEELSPAPSESSKASPEKDSLGNSKGENAANWLTAKSGRKKRCPYTKHQTLELEKEFLFNMYLTRERRLEISRSVHLTDRQVKIWFQNRRMKLKKMNRENRIRELTANFNFS

SEQ ID NO: 15114 - protein, 313 aa, Homo Sapiens
MDFDERGPCSSNMYLPSCTYYVSGPDFSSLPSFLPQTPSSRPMTYSYSSNLPQVQPVREVTFREYAIEPATKWHPRGNLAHCYSAEELVHRDCLQAPSAAGVPGDVLAKSSANVYHHPTPAVSSNFYSTVGRNGVLPQAFDQFFETAYGTPENLASSDYPGDKSAEKGPPAATATSAAAAAAATGAPATSSSDSGGGGGCRETAAAAEEKERRRRPESSSSPESSSGHTEDKAGGSSGQRTRKKRCPYTKYQIRELEREFFFSVYINKEKRLQLSRMLNLTDRQVKIWFQNRRMKEKKINRDRLQYYSANPLL

SEQ ID NO: 15115 - protein, 388 aa, Homo Sapiens
MTASVLLHPRWIEPTVMFLYDNGGGLVADELNKNMEGAAAAAAAAAAAAAAGAGGGGFPHPAAAAAGGNFSVAAAAAAAAAAAANQCRNLMAHPAPLAPGAASAYSSAPGEAPPSAAAAAAAAAAAAAAAAAASSSGGPGPAGPAGAEAAKQCSPCSAAAQSSSGPAALPYGYFGSGYYPCARMGPHPNAIKSCAQPASAAAAAAFADKYMDTAGPAAEEFSSRAKEFAFYHQGYAAGPYHHHQPMPGYLDMPVVPGLGGPGESRHEPLGLPMESYQPWALPNGWNGQMYCPKEQAQPPHLWKSTLPDVVSHPSDASSYRRGRKKRVPYTKVQLKELEREYATNKFITKDKRRRISATTNLSERQVTIWFQNRRVKEKKVINKLKTTS

SEQ ID NO: 15116 - protein, 376 aa, Homo Sapiens
MNYEFEREIGFINSQPSLAECLTSFPPVADTFQSSSIKTSTLSHSTLIPPPFEQTIPSLNPGSHPRHGAGGRPKPSPAGSRGSPVPAGALQPPEYPWMKEKKAAKKTALLPAAAAAATAAATGPACLSHKESLEIADGSGGGSRRLRTAYTNTQLLELEKEFHFNKYLCRPRRVEIAALLDLTERQVKVWFQNRRMKHKRQTQCKENQNSEGKCKSLEDSEKVEEDEEEKTLFEQALSVSGALLEREGYTFQQNALSQQQAPNGHNGDSQSFPVSPLTSNEKNLKHFQHQSPTVPNCLSTMGQNCGAGLNNDSPEALEVPSLQDFSVFSTDSCLQLSDAVSPSLPGSLDSPVDISADSLDFFTDTLTTIDLQHLNY

SEQ ID NO: 15117 - protein, 443 aa, Homo Sapiens
MQKATYYDSSAIYGGYPYQAANGFAYNANQQPYPASAALGADGEYHRPACSLQSPSSAGGHPKAHELSEACLRTLSAPPSQPPSLGEPPLHPPPPQAAPPAPQPPQPAPQPPAPTPAAPPPPSSASPPQNASNNPTPANAAKSPLLNSPTVAKQIFPWMKESRQNTKQKTSSSSSGESCAGDKSPPGQASSKRARTAYTSAQLVELEKEFHFNRYLCRPRRVEMANLLNLTERQIKIWFQNRRMKYKKDQKGKGMLTSSGGQSPSRSPVPPGAGGYLNSMHSLVNSVPYEPQSPPPFSKPPQGTYGLPPASYPASLPSCAPPPPPQKRYTAAGAGAGGTPDYDPHAHGLQGNGSYGTPHIQGSPVFVGGSYVEPMSNSGPALFGLTHLPHAASGAMDYGGAGPLGSGHHHGPGPGEPHPTYTDLTGHHPSQGRIQEAPKLTHL

SEQ ID NO: 15118 - protein, 320 aa, Homo Sapiens
MTMSSFLINSNYIEPKFPPFEEYAQHSGSGGADGGPGGGPGYQQPPAPPTQHLPLQQPQLPHAGGGREPTASYYAPRTAREPAYPAAALYPAHGAADTAYPYGYRGGASPGRPPQPEQPPAQAKGPAHGLHASHVLQPQLPPPLQPRAVPPAAPRRCEAAPATPGVPAGGSAPACPLLLADKSPLGLKGKEPVVYPWMKKIHVSAVNPSYNGGEPKRSRTAYTRQQVLELEKEFHFNRYLTRRRRIEIAHTLCLSERQVKIWFQNRRMKWKKDHKLPNTKMRSSNSASASAGPPGKAQTQSPHLHPHPHPSTSTPVPSSI

SEQ ID NO: 15119 - protein, 270 aa, Homo Sapiens
MSSYFVNSFCGRYPNGPDYQLHNYGDHSSVSEQFRDSASMHSGRYGYGYNGMDLSVGRSGSGHFGSGERARSYAASASAAPAEPRYSQPATSTHSPQPDPLPCSAVAPSPGSDSHHGGKNSLSNSSGASADAGSTHISSREGVGTASGAEEDAPASSEQASAQSEPSPAPPAQPQIYPWMRKLHISHDNIGGPEGKRARTAYTRYQTLELEKEFHFNRYLTRRRRIEIAHALCLSERQIKIWFQNRRMKWKKDNKLKSMSMAAAGGAFRP

SEQ ID NO: 15120 - protein, 233 aa, Homo Sapiens
MSSYFVNPTFPGSLPSGQDSFLGQLPLYQAGYDALRPFPASYGASSLPDKTYTSPCFYQQSNSVLACNRASYEYGASCFYSDKDLSGASPSGSGKQRGPGDYLHFSPEQQYKPDSSSGQGKALHDEGADRKYTSPVYPWMQRMNSCAGAVYGSHGRRGRQTYTRYQTLELEKEFHFNRYLTRRRRIEIANALCLTERQIKIWFQNRRMKWKKENKLINSTQPSGEDSEAKAGE

SEQ ID NO: 15121 - protein, 230 aa, Homo Sapiens
MSSSYYVNALFSKYTAGASLFQNAEPTSCSFAPNSQRSGYGAGAGAFASTVPGLYNVNSPLYQSPFASGYGLGADAYGNLPCASYDQNIPGLCSDLAKGACDKTDEGALHGAAEANFRIYPWMRSSGPDRKRGRQTYTRYQTLELEKEFHFNRYLTRRRRIEIAHALCLTERQIKIWFQNRRMKWKKEHKDEGPTAAAAPEGAVPSAAATAAADKADEEDDDEEEEDEEE

SEQ ID NO: 15122 - protein, 272 aa, Homo Sapiens
MATTGALGNYYVDSFLLGADAADELSVGRYAPGTLGQPPRQAATLAEHPDFSPCSFQSKATVFGASWNPVHAAGANAVPAAVYHHHHHHPYVHPQAPVAAAAPDGRYMRSWLEPTPGALSFAGLPSSRPYGIKPEPLSARRGDCPTLDTHTLSLTDYACGSPPVDREKQPSEGAFSENNAENESGGDKPPIDPNNPAANWLHARSTRKKRCPYTKHQTLELEKEFLFNMYLTRDRRYEVARLLNLTERQVKIWFQNRRMKMKKINKDRAKDE

SEQ ID NO: 15123 - protein, 301 aa, Homo Sapiens
MDYNRMNSFLEYPLCNRGPSAYSAHSAPTSFPPSSAQAVDSYASEGRYGGGLSSPAFQQNSGYPAQQPPSTLGVPFPSSAPSGYAPAACSPSYGPSQYYPLGQSEGDGGYFHPSSYGAQLGGLSDGYGAGGAGPGPYPPQHPPYGNEQTASFAPAYADLLSEDKETPCPSEPNTPTARTFDWMKVKRNPPKTAKVSEPGLGSPSGLRTNFTTRQLTELEKEFHFNKYLSRARRVEIAATLELNETQVKIWFQNRRMKQKKREREEGRVPPAPPGCPKEAAGDASDQSTCTSPEASPSSVTS

SEQ ID NO: 15124 - protein, 284 aa, Homo Sapiens
MEPGNYATLDGAKDIEGLLGAGGGRNLVAHSPLTSHPAAPTLMPAVNYAPLDLPGSAEPPKQCHPCPGVPQGTSPAPVPYGYFGGGYYSCRVSRSSLKPCAQAATLAAYPAETPTAGEEYPSRPTEFAFYPGYPGTYQPMASYLDVSVVQTLGAPGEPRHDSLLPVDSYQSWALAGGWNSQMCCQGEQNPPGPFWKAAFADSSGQHPPDACAFRRGRKKRIPYSKGQLRELEREYAANKFITKDKRRKISAATSLSERQITIWFQNRRVKEKKVLAKVKNSATP

SEQ ID NO: 15125 - protein, 356 aa, Homo Sapiens
MNFEFEREIGFINSQPSLAECLTSFPAVLETFQTSSIKESTLIPPPPPFEQTFPSLQPGASTLQRPRSQKRAEDGPALPPPPPPPLPAAPPAPEFPWMKEKKSAKKPSQSATSPSPAASAVPASGVGSPADGLGLPEAGGGGARRLRTAYTNTQLLELEKEFHFNKYLCRPRRVEIAALLDLTERQVKVWFQNRRMKHKRQTQHREPPDGEPACPGALEDICDPAEEPAASPGGPSASRAAWEACCHPPEVVPGALSADPRPLAVRLEGAGASSPGCALRGAGGLEPGPLPEDVFSGRQDSPFLPDLNFFAADSCLQLSGGLSPSLQGSLDSPVPFSEEELDFFTSTLCAIDLQFP

SEQ ID NO: 15126 - protein, 431 aa, Homo Sapiens
MQKATYYDNAAAALFGGYSSYPGSNGFGFDVPPQPPFQAATHLEGDYQRSACSLQSLGNAAPHAKSKELNGSCMRPGLAPEPLSAPPGSPPPSAAPTSATSNSSNGGGPSKSGPPKCGPGTNSTLTKQIFPWMKESRQTSKLKNNSPGTAEGCGGGGGGGGGGGSGGSGGGGGGGGGGDKSPPGSAASKRARTAYTSAQLVELEKEFHFNRYLCRPRRVEMANLLNLSERQIKIWFQNRRMKYKKDQKAKGLASSSGGPSPAGSPPQPMQSTAGFMNALHSMTPSYESPSPPAFGKAHQNAYALPSNYQPPLKGCGAPQKYPPTPAPEYEPHVLQANGGAYGTPTMQGSPVYVGGGGYADPLPPPAGPSLYGLNHLSHHPSGNLDYNGAPPMAPSQHHGPCEPHPTYTDLSSHHAPPPQGRIQEAPKLTHL

SEQ ID NO: 15127 - protein, 251 aa, Homo Sapiens
MAMSSFLINSNYVDPKFPPCEEYSQSDYLPSDHSPGYYAGGQRRESSFQPEAGFGRRAACTVQRYAACRDPGPPPPPPPPPPPPPPPGLSPRAPAPPPAGALLPEPGQRCEAVSSSPPPPPCAQNPLHPSPSHSACKEPVVYPWMRKVHVSTVNPNYAGGEPKRSRTAYTRQQVLELEKEFHYNRYLTRRRRVEIAHALCLSERQIKIWFQNRRMKWKKDHKLPNTKIRSGGAAGSAGGPPGRPNGGPRAL

SEQ ID NO: 15128 - protein, 269 aa, Homo Sapiens
MSSYFVNSFSGRYPNGPDYQLLNYGSGSSLSGSYRDPAAMHTGSYGYNYNGMDLSVNRSSASSSHFGAVGESSRAFPAPAQEPRFRQAASSCSLSSPESLPCTNGDSHGAKPSASSPSDQATSASSSANFTEIDEASASSEPEEAASQLSSPSLARAQPEPMATSTAAPEGQTPQIFPWMRKLHISHDMTGPDGKRARTAYTRYQTLELEKEFHFNRYLTRRRRIEIAHALCLSERQIKIWFQNRRMKWKKDNKLKSMSLATAGSAFQP

SEQ ID NO: 15129 - protein, 224 aa, Homo Sapiens
MSSYFVNSTFPVTLASGQESFLGQLPLYSSGYADPLRHYPAPYGPGPGQDKGFATSSYYPPAGGGYGRAAPCDYGPAPAFYREKESACALSGADEQPPFHPEPRKSDCAQDKSVFGETEEQKCSTPVYPWMQRMNSCNSSSFGPSGRRGRQTYTRYQTLELEKEFHYNRYLTRRRRIEIAHALCLTERQIKIWFQNRRMKWKKESKLLSASQLSAEEEEEKQAE

SEQ ID NO: 15130 - protein, 217 aa, Homo Sapiens
MSSLYYANTLFSKYPASSSVFATGAFPEQTSCAFASNPQRPGYGAGSGASFAASMQGLYPGGGGMAGQSAAGVYAAGYGLEPSSFNMHCAPFEQNLSGVCPGDSAKAAGAKEQRDSDLAAESNFRIYPWMRSSGTDRKRGRQTYTRYQTLELEKEFHYNRYLTRRRRIEIAHTLCLTERQIKIWFQNRRMKWKKENKTAGPGTTGQDRAEAEEEEEE

SEQ ID NO: 15131 - protein, 243 aa, Homo Sapiens
MSSYFVNSLFSKYKTGESLRPNYYDCGFAQDLGGRPTVVYGPSSGGSFQHPSQIQEFYHGPSSLSTAPYQQNPCAVACHGDPGNFYGYDPLQRQSLFGAQDPDLVQYADCKLAAASGLGEEAEGSEQSPSPTQLFPWMRPQAAAGRRRGRQTYSRYQTLELEKEFLFNPYLTRKRRIEVSHALGLTERQVKIWFQNRRMKWKKENNKDKFPSSKCEQEELEKQKLERAPEAADEGDAQKGDKK

SEQ ID NO: 15132 - protein, 250 aa, Homo Sapiens
MSISGTLSSYYVDSIISHESEDAPPAKFPSGQYASSRQPGHAEHLEFPSCSFQPKAPVFGASWAPLSPHASGSLPSVYHPYIQPQGVPPAESRYLRTWLEPAPRGEAAPGQGQAAVKAEPLLGAPGELLKQGTPEYSLETSAGREAVLSNQRPGYGDNKICEGSEDKERPDQTNPSANWLHARSSRKKRCPYTKYQTLELEKEFLFNMYLTRDRRHEVARLLNLSERQVKIWFQNRRMKMKKMNKEQGKE

SEQ ID NO: 15133 - protein, 342 aa, Homo Sapiens
MTCPRNVTPNSYAEPLAAPGGGERYSRSAGMYMQSGSDFNCGVMRGCGLAPSLSKRDEGSSPSLALNTYPSYLSQLDSWGDPKAAYRLEQPVGRPLSSCSYPPSVKEENVCCMYSAEKRAKSGPEAALYSHPLPESCLGEHEVPVPSYYRASPSYSALDKTPHCSGANDFEAPFEQRASLNPRAEHLESPQLGGKVSFPETPKSDSQTPSPNEIKTEQSLAGPKGSPSESEKERAKAADSSPDTSDNEAKEEIKAENTTGNWLTAKSGRKKRCPYTKHQTLELEKEFLFNMYLTRERRLEISKTINLTDRQVKIWFQNRRMKLKKMNRENRIRELTSNFNFT

SEQ ID NO: 15134 - protein, 304 aa, Homo Sapiens
MFNSVNLGNFCSPSRKERGADFGERGSCASNLYLPSCTYYMPEFSTVSSFLPQAPSRQISYPYSAQVPPVREVSYGLEPSGKWHHRNSYSSCYAAADELMHRECLPPSTVTEILMKNEGSYGGHHHPSAPHATPAGFYSSVNKNSVLPQAFDRFFDNAYCGGGDPPAEPPCSGKGEAKGEPEAPPASGLASRAEAGAEAEAEEENTNPSSSGSAHSVAKEPAKGAAPNAPRTRKKRCPYSKFQIRELEREFFFNVYINKEKRLQLSRMLNLTDRQVKIWFQNRRMKEKKLSRDRLQYFSGNPLL

SEQ ID NO: 15135 - protein, 282 aa, Homo Sapiens
MGEHNLLNPGFVGPLVNIHTGDTFYFPNFRASGAQLPGLPSLSYPRRDNVCSLSWPSAEPCNGYPQPYLGSPVSLNPPFGRTCELARVEDGKGYYREPCAEGGGGGLKREERGRDPGAGPGAALLPLEPSGPPALGFKYDYAAGGGGGDGGGGAGPPHDPPSCQSLESDSSSSLLNEGNKGAGAGDPGSLVSPLNPGGGLSASGAPWYPINSRSRKKRKPYSKLQLAELEGEFLVNEFITRQRRRELSDRLNLSDQQVKIWFQNRRMKKKRLLLREQALSFF

SEQ ID NO: 15136 - protein, 330 aa, Homo Sapiens
MTTSLLLHPRWPESLMYVYEDSAAESGIGGGGGGGGGGTGGAGGGCSGASPGKAPSMDGLGSSCPASHCRDLLPHPVLGRPPAPLGAPQGAVYTDIPAPEAARQCAPPPAPPTSSSATLGYGYPFGGSYYGCRLSHNVNLQQKPCAYHPGDKYPEPSGALPGDDLSSRAKEFAFYPSFASSYQAMPGYLDVSVVPGISGHPEPRHDALIPVEGYQHWALSNGWDSQVYCSKEQSQSAHLWKSPFPDVVPLQPEVSSYRRGRKKRVPYTKVQLKELEKEYAASKFITKEKRRRISATTNLSERQVTIWFQNRRVKEKKVVSKSKAPHLHST

SEQ ID NO: 15137 - protein, 264 aa, Homo Sapiens
MIMSSYLMDSNYIDPKFPPCEEYSQNSYIPEHSPEYYGRTRESGFQHHHQELYPPPPPRPSYPERQYSCTSLQGPGNSRGHGPAQAGHHHPEKSQSLCEPAPLSGASASPSPAPPACSQPAPDHPSSAASKQPIVYPWMKKIHVSTVNPNYNGGEPKRSRTAYTRQQVLELEKEFHYNRYLTRRRRIEIAHSLCLSERQIKIWFQNRRMKWKKDHRLPNTKVRSAPPAGAAPSTLSAATPGTSEDHSQSATPPEQQRAEDITRL

SEQ ID NO: 15138 - protein, 222 aa, Homo Sapiens
MSSYVANSFYKQSPNIPAYNMQTCGNYGSASEVQASRYCYGGLDLSITFPPPAPSNSLHGVDMAANPRAHPDRPACSAAAAPGHAPGRDEAAPLNPGMYSQKAARPALEERAKSSGEIKEEQAQTGQPAGLSQPPAPPQIYPWMTKLHMSHETDGKRSRTSYTRYQTLELEKEFHFNRYLTRRRRIEIANNLCLNERQIKIWFQNRRMKWKKDSKMKSKEAL

SEQ ID NO: 15139 - protein, 235 aa, Homo Sapiens
MNSYFTNPSLSCHLAGGQDVLPNVALNSTAYDPVRHFSTYGAAVAQNRIYSTPFYSPQENVVFSSSRGPYDYGSNSFYQEKDMLSNCRQNTLGHNTQTSIAQDFSSEQGRTAPQDQKASIQIYPWMQRMNSHSGVGYGADRRRGRQIYSRYQTLELEKEFHFNRYLTRRRRIEIANALCLTERQIKIWFQNRRMKWKKESNLTSTLSGGGGGATADSLGGKEEKREETEEEKQKE

SEQ ID NO: 15140 - protein, 242 aa, Homo Sapiens
MSSYFVNPLFSKYKAGESLEPAYYDCRFPQSVGRSHALVYGPGGSAPGFQHASHHVQDFFHHGTSGISNSGYQQNPCSLSCHGDASKFYGYEALPRQSLYGAQQEASVVQYPDCKSSANTNSSEGQGHLNQNSSPSLMFPWMRPHAPGRRSGRQTYSRYQTLELEKEFLFNPYLTRKRRIEVSHALGLTERQVKIWFQNRRMKWKKENNKDKLPGARDEEKVEEEGNEEEEKEEEEKEENKD

SEQ ID NO: 15141 - protein, 260 aa, Homo Sapiens
MSATGPISNYYVDSLISHDNEDLLASRFPATGAHPAAARPSGLVPDCSDFPSCSFAPKPAVFSTSWAPVPSQSSVVYHPYGPQPHLGADTRYMRTWLEPLSGAVSFPSFPAGGRHYALKPDAYPGRRADCGPGEGRSYPDYMYGSPGELRDRAPQTLPSPEADALAGSKHKEEKADLDPSNPVANWIHARSTRKKRCPYTKYQTLELEKEFLFNMYLTRDRRYEVARVLNLTERQVKIWFQNRRMKMKKMNKEKTDKEQS

SEQ ID NO: 15142 - protein, 328 aa, Homo Sapiens
MSSYLEYVSCSSSGGVGGDVLSLAPKFCRSDARPVALQPAFPLGNGDGAFVSCLPLAAARPSPSPPAAPARPSVPPPAAPQYAQCTLEGAYEPGAAPAAAAGGADYGFLGSGPAYDFPGVLGRAADDGGSHVHYATSAVFSGGGSFLLSGQVDYAAFGEPGPFPACLKASADGHPGAFQTASPAPGTYPKSVSPASGLPAAFSTFEWMKVKRNASKKGKLAEYGAASPSSAIRTNFSTKQLTELEKEFHFNKYLTRARRIEIANCLHLNDTQVKIWFQNRRMKQKKREREGLLATAIPVAPLQLPLSGTTPTKFIKNPGSPSQSQEPS

SEQ ID NO: 15143 - protein, 340 aa, Homo Sapiens
MSFPNSSPAANTFLVDSLISACRSDSFYSSSASMYMPPPSADMGTYGMQTCGLLPSLAKREVNHQNMGMNVHPYIPQVDSWTDPNRSCRIEQPVTQQVPTCSFTTNIKEESNCCMYSDKRNKLISAEVPSYQRLVPESCPVENPEVPVPGYFRLSQTYATGKTQEYNNSPEGSSTVMLQLNPRGAAKPQLSAAQLQMEKKMNEPVSGQEPTKVSQVESPEAKGGLPEERSCLAEVSVSSPEVQEKESKEEIKSDTPTSNWLTAKSGRKKRCPYTKHQTLELEKEFLFNMYLTRERRLEISKSVNLTDRQVKIWFQNRRMKLKKMSRENRIRELTANLTFS

SEQ ID NO: 15144 - protein, 338 aa, Homo Sapiens
MNDFDECGQSAASMYLPGCAYYVAPSDFASKPSFLSQPSSCQMTFPYSSNLAPHVQPVREVAFRDYGLERAKWPYRGGGGGGSAGGGSSGGGPGGGGGGAGGYAPYYAAAAAAAAAAAAAEEAAMQRELLPPAGRRPDVLFKAPEPVCAAPGPPHGPAGAASNFYSAVGRNGILPQGFDQFYEAAPGPPFAGPQPPPPPAPPQPEGAADKGDPRTGAGGGGGSPCTKATPGSEPKGAAEGSGGDGEGPPGEAGAEKSSSAVAPQRSRKKRCPYTKYQIRELEREFFFNVYINKEKRLQLSRMLNLTDRQVKIWFQNRRMKEKKLNRDRLQYFTGNPLF

SEQ ID NO: 15145 - protein, 270 aa, Homo Sapiens
MCERSLYRAGYVGSLLNLQSPDSFYFSNLRPNGGQLAALPPISYPRGALPWAATPASCAPAQPAGATAFGGFSQPYLAGSGPLGLQPPTAKDGPEEQAKFYAPEAAAGPEERGRTRPSFAPESSLAPAVAALKAAKYDYAGVGRATPGSTTLLQGAPCAPGFKDDTKGPLNLNMTVQAAGVASCLRPSLPDGLPWGAAPGRARKKRKPYTKQQIAELENEFLVNEFINRQKRKELSNRLNLSDQQVKIWFQNRRMKKKRVVLREQALALY

SEQ ID NO: 15146 - protein, 343 aa, Homo Sapiens
MSRAGSWDMDGLRADGGGAGGAPASSSSSSVAAAAASGQCRGFLSAPVFAGTHSGRAAAAAAAAAAAAAAASGFAYPGTSERTGSSSSSSSSAVVAARPEAPPAKECPAPTPAAAAAAPPSAPALGYGYHFGNGYYSCRMSHGVGLQQNALKSSPHASLGGFPVEKYMDVSGLASSSVPANEVPARAKEVSFYQGYTSPYQHVPGYIDMVSTFGSGEPRHEAYISMEGYQSWTLANGWNSQVYCTKDQPQGSHFWKSSFPGDVALNQPDMCVYRRGRKKRVPYTKLQLKELENEYAINKFINKDKRRRISAATNLSERQVTIWFQNRRVKDKKIVSKLKDTVS

SEQ ID NO: 15147 - protein, 432 aa, Homo Sapiens
MLFEQGQQALELPECTMQKAAYYENPGLFGGYGYSKTTDTYGYSTPHQPYPPPAAASSLDTDYPGSACSIQSSAPLRAPAHKGAELNGSCMRPGTGNSQGGGGGSQPPGLNSEQQPPQPPPPPPTLPPSSPTNPGGGVPAKKPKGGPNASSSSATISKQIFPWMKESRQNSKQKNSCATAGESCEDKSPPGPASKRVRTAYTSAQLVELEKEFHFNRYLCRPRRVEMANLLNLTERQIKIWFQNRRMKYKKDQKAKGILHSPASQSPERSPPLGGAAGHVAYSGQLPPVPGLAYDAPSPPAFAKSQPNMYGLAAYTAPLSSCLPQQKRYAAPEFEPHPMASNGGGFASANLQGSPVYVGGNFVESMAPASGPVFNLGHLSHPSSASVDYSCAAQIPGNHHHGPCDPHPTYTDLSAHHSSQGRLPEAPKLTHL

SEQ ID NO: 15148 - protein, 255 aa, Homo Sapiens
MVMSSYMVNSKYVDPKFPPCEEYLQGGYLGEQGADYYGGGAQGADFQPPGLYPRPDFGEQPFGGSGPGPGSALPARGHGQEPGGPGGHYAAPGEPCPAPPAPPPAPLPGARAYSQSDPKQPPSGTALKQPAVVYPWMKKVHVNSVNPNYTGGEPKRSRTAYTRQQVLELEKEFHFNRYLTRRRRIEIAHTLCLSERQIKIWFQNRRMKWKKDHKLPNTKGRSSSSSSSSSCSSSVAPSQHLQPMAKDHHTDLTTL

SEQ ID NO: 15149 - protein, 290 aa, Homo Sapiens
MSSYFVNPLYSKYKAAAAAAAAAGEAINPTYYDCHFAPEVGGRHAAAAAALQLYGNSAAGFPHAPPQAHAHPHPSPPPSGTGCGGREGRGQEYFHPGGGSPAAAYQAAPPPPPHPPPPPPPPPCGGIACHGEPAKFYGYDNLQRQPIFTTQQEAELVQYPDCKSSSGNIGEDPDHLNQSSSPSQMFPWMRPQAAPGRRRGRQTYSRFQTLELEKEFLFNPYLTRKRRIEVSHALALTERQVKIWFQNRRMKWKKENNKDKFPVSRQEVKDGETKKEAQELEEDRAEGLTN

SEQ ID NO: 15150 - protein, 352 aa, Homo Sapiens
MLGGSAGRLKMSSSGTLSNYYVDSLIGHEGDEVFAARFGPPGPGAQGRPAGVADGPAATAAEFASCSFAPRSAVFSASWSAVPSQPPAAAAMSGLYHPYVPPPPLAASASEPGRYVRSWMEPLPGFPGGAGGGGGGGGGGPGRGPSPGPSGPANGRHYGIKPETRAAPAPATAASTTSSSSTSLSSSSKRTECSVARESQGSSGPEFSCNSFLQEKAAAATGGTGPGAGIGAATGTGGSSEPSACSDHPIPGCSLKEEEKQHSQPQQQQLDPNNPAANWIHARSTRKKRCPYTKYQTLELEKEFLFNMYLTRDRRYEVARILNLTERQVKIWFQNRRMKMKKMSKEKCPKGD

SEQ ID NO: 15151 - protein, 529 aa, Homo Sapiens
MDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 15152 - protein, 536 aa, Homo Sapiens
MKQSSNVPAFLSKLWTLVEETHTNEFITWSQNGQSFLVLDEQRFAKEILPKYFKHNNMASFVRQLNMYGFRKVVHIDSGIVKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAQKKNLFQHIVKEPTDNHHHKVPHSRTEGLKPRERISDDIIIYDVTDDNADEENIPVIPETNEDVISDPSNCSQYPDIVIVEDDNEDEYAPVIQSGEQNEPARESLSSGSDGSSPLMSSAVQLNGSSSLTSEDPVTMMDSILNDNINLLGKVELLDYLDSIDCSLEDFQAMLSGRQFSIDPDLLVDLFTSSVQMNPTDYINNTKSENKGLETTKNNVVQPVSEEGRKSKSKPDKQLIQYTAFPLLAFLDGNPASSVEQASTTASSEVLSSVDKPIEVDELLDSSLDPEPTQSKLVRLEPLTEAEASEATLFYLCELAPAPLDSDMPLLDS

SEQ ID NO: 15153 - protein, 492 aa, Homo Sapiens
MQEAPAALPTEPGPSPVPAFLGKLWALVGDPGTDHLIRWSPSGTSFLVSDQSRFAKEVLPQYFKHSNMASFVRQLNMYGFRKVVSIEQGGLLRPERDHVEFQHPSFVRGREQLLERVRRKVPALRGDDGRWRPEDLGRLLGEVQALRGVQESTEARLRELRQQNEILWREVVTLRQSHGQQHRVIGKLIQCLFGPLQAGPSNAGGKRKLSLMLDEGSSCPTPAKFNTCPLPGALLQDPYFIQSPLPETNLGLSPHRARGPIISDIPEDSPSPEGTRLSPSSDGRREKGLALLKEEPASPGGDGEAGLALAPNECDFCVTAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 15154 - protein, 596 aa, Homo Sapiens
MEALLSTPINPNNFPAKLWRLVNSPRYRSIRWDGRGEGLLIDQPLFEAELLSPPGPGGGGGTAGAGAEPELFKTTSFTSFIRQLNLYGFRKVVLGGPGGGKPAGNGPLHHFHNPHFRRDQPQLLVHLKRLTSANKAKLAAGLEVPCRPPNRFQRLLITSASAATAPLQHQQPPPPAGPRPEPHGPVAVGQFHRSFRRDSLSPYSCVSTPSHDHSTYPLKGLDRTPVPHRIWQNSLGMHPGQVETSPTFSDKGVPFPVLQRFPTEVTYTLQPSTTSVHVQQGPQTMVSSSQKYSNYTPSAQYSQAYYPTAVLQCCSPTHMDALSSCVTPNASSYAHCNYFQNPSMQSSYPVEFLPSNWPCSTTDENTKTEVNLEAVFQIVDELHSSPKLEMVKVEPVENQCPTSPSYRGQHILANSNNSNPCSASQASQLEPLTPVGSDIMSFVVGTEQAVACSLPQSPEYIYTIHTAQPVENSTIQESAAIQQAHVKLKEHLNHNPSPSSVVFVQEGPPFSTHQVDANIKCQTSSRENILPSEQMGFLISEMGPASKPSEDTGLATPARYREHRSNSQQGKSPDLHLLVDVACKQERFPKEEELKE

SEQ ID NO: 15155 - protein, 423 aa, Homo Sapiens
MEDKRSLSMARCEERNSRGQDHGLERVPFPPQLQSETYLHPADPSPAWDDPGSTGSPNLRLLTEEIAFQPLAEEASFRRPHPDGDVPPQGEDNLLSLPFPQKLWRLVSSNQFSSIWWDDSGACRVINQKLFEKEILKRDVAHKVFATTSIKSFFRQLNLYGFRKRRQCTFRTFTRIFSAKRLVSILNKLEFYCHPYFQRDSPHLLVRMKRRVGVKSAPRHQEEDKPEAAGSCLAPADTEQQDHTSPNENDQVTPQHREPAGPNTQIRSGSAPPATPVMVPDSAVASDNSPVTQPAGEWSEGSQAHVTPVAAVPGPAALPFLYVPGSPTQMNSYGPVVALPTASRSTLAMDTTGLPAPGMLPFCHLWVPVTLVAAGAAQPAASMVMFPHLPALHHHCPHSHRTSQYMPASDGPQAYPDYADQST

SEQ ID NO: 15156 - protein, 401 aa, Homo Sapiens
MAHVSSETQDVSPKDELTASEASTRSPLCEHTFPGDSDLRSMIEEHAFQVLSQGSLLESPSYTVCVSEPDKDDDFLSLNFPRKLWKIVESDQFKSISWDENGTCIVINEELFKKEILETKAPYRIFQTDAIKSFVRQLNLYGFSKIQQNFQRSAFLATFLSEEKESSVLSKLKFYYNPNFKRGYPQLLVRVKRRIGVKNASPISTLFNEDFNKKHFRAGANMENHNSALAAEASEESLFSASKNLNMPLTRESSVRQIIANSSVPIRSGFPPPSPSTSVGPSEQIATDQHAILNQLTTIHMHSHSTYMQARGHIVNFITTTTSQYHIISPLQNGYFGLTVEPSAVPTRYPLVSVNEAPYRNMLPAGNPWLQMPTIADRSAAPHSRLALQPSPLDKYHPNYN

SEQ ID NO: 15157 - protein, 155 aa, Homo Sapiens; identical to SEQ ID NO: 6697

SEQ ID NO: 15158 - protein, 134 aa, Homo Sapiens
MKAFSPVRSVRKNSLSDHSLGISRSKTPVDDPMSLLYNMNDCYSKLKELVPSIPQNKKVSKMEILQHVIDYILDLQIALDSHPTIVSLHHQRPGQNQASRTPLTTLNTDISILSLQASEFPSELMSNDSKALCG

SEQ ID NO: 15159 - protein, 119 aa, Homo Sapiens
MKALSPVRGCYEAVCCLSERSLAIARGRGKGPAAEEPLSLLDDMNHCYSRLRELVPGVPRGTQLSQVEILQRVIDYILDLQVVLAEPAPGPPDGPHLPIQTAELTPELVISNDKRSFCH

SEQ ID NO: 15160 - protein, 161 aa, Homo Sapiens
MKAVSPVRPSGRKAPSGCGGGELALRCLAEHGHSLGGSAAAAAAAAAARCKAAEAAADEPALCLQCDMNDCYSRLRRLVPTIPPNKKVSKVEILQHVIDYILDLQLALETHPALLRQPPPPAPPHHPAGTCPAAPPRTPLTALNTDPAGAVNKQGDSILCR

SEQ ID NO: 15161 - protein, 785 aa, Homo Sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNSSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQRQLPYPSEASTTFPESHLRTPQMPPTTPSSSFFTKKSEDTISKMNDFMRMQILKEGSHFPGPFMTSIGPAESHPHTPQMPPSTPSSSFLTTKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 15162 - protein, 519 aa, Homo Sapiens
MDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGERPFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 15163 - protein, 526 aa, Homo Sapiens [sequence omitted]

SEQ ID NO: 15164 - protein, 509 aa, Homo Sapiens
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSVEKPYKCEFCGRSYKQRSSLEEHKERCRTFLQSTDPGDTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 15165 - protein, 585 aa, Homo Sapiens
MHTPPALPRRFQGGGRVRTPGSHRQGKDNLERDPSGGCVPDFLPQAQDSNHFIMESLFCESSGDSSLEKEFLGAPVGPSVSTPNSQHSSPSRSLSANSIKVEMYSDEESSRLLGPDERLLEKDDSVIVEDSLSEPLGYCDGSGPEPHSPGGIRLPNGKLKCDVCGMVCIGPNVLMVHKRSHTGERPFHCNQCGASFTQKGNLLRHIKLHSGEKPFKCPFCNYACRRRDALTGHLRTHSVSSPTVGKPYKCNYCGRSYKQQSTLEEHKERCHNYLQSLSTEAQALAGQPGDEIRDLEMVPDSMLHSSSERPTFIDRLANSLTKRKRSTPQKFVGEKQMRFSLSDLPYDVNSGGYEKDVELVAHHSLEPGFGSSLAFVGAEHLRPLRLPPTNCISELTPVISSVYTQMQPLPGRLELPGSREAGEGPEDLADGGPLLYRPRGPLTDPGASPSNGCQDSTDTESNHEDRVAGVVSLPQGPPPQPPPTIVVGRHSPAYAKEDPKPQEGLLRGTPGPSKEVLRVVGESGEPVKAFKCEHCRILFLDHVMFTIHMGCHGFRDPFECNICGYHSQDRYEFSSHIVRGEHKVG

SEQ ID NO: 15166 - protein, 419 aa, Homo Sapiens
MGEKKPEPLDFVKDFQEYLTQQTHHVNMISGSVSGDKEAEALQGAGTDGDQNGLDHPSVEVSLDENSGMLVDGFERTFDGKLKCRYCNYASKGTARLIEHIRIHTGEKPHRCHLCPFASAYERHLEAHMRSHTGEKPYKCELCSFRCSDRSNLSHHRRRKHKMVPIKGTRSSLSSKKMWGVLQKKTSNLGYSRRALINLSPPSMVVQKPDYLNDFTHEIPNIQTDSYESMAKTTPTGGLPRDPQELMVDNPLNQLSTLAGQLSSLPPENQNPASPDVVPCPDEKPFMIQQPSTQAVVSAVSASIPQSSSPTSPEPRPSHSQRNYSPVAGPSSEPSAHTSTPSIGNSQPSTPAPALPVQDPQLLHHCQHCDMYFADNILYTIHMGCHGYENPFQCNICGCKCKNKYDFACHFARGQHNQH

SEQ ID NO: 15167 - protein, 510 aa, Homo Sapiens
MPRGFLVKRSKKSTPVSYRVRGGEDGDRALLLSPSCGGARAEPPAPSPVPGPLPPPPPAERAHAALAAALACAPGPQPPPQGPRAAHFGNPEAAHPAPLYSPTRPVSREHEKHKYFERSFNLGSPVSAESFPTPAALLGGGGGGGASGAGGGGTCGGDPLLFAPAELKMGTAFSAGAEAARGPGPGPPLPPAAALRPPGKRPPPPTAAEPPAKAVKAPGAKKPKAIRKLHFEDEVTTSPVLGLKIKEGPVEAPRGRAGGAARPLGEFICQLCKEEYADPFALAQHKCSRIVRVEYRCPECAKVFSCPANLASHRRWHKPRPAPAAARAPEPEAAARAEAREAPGGGSDRDTPSPGGVSESGSEDGLYECHHCAKKFRRQAYLRKHLLAHHQALQAKGAPLAPPAEDLLALYPGPDEKAPQEAAGDGEGAGVLGLSASAECHLCPVCGESFASKGAQERHLRLLHAAQVFPCKYCPATFYSSPGLTRHINKCHPSENRQVILLQVPVRPAC

SEQ ID NO: 15168 - protein, 566 aa, Homo Sapiens
MPRGFLVKRTKRTGGLYRVRLAERVFPLLGPQGAPPFLEEAPSASLPGAERATPPTREEPGKGLTAEAAREQSGSPCRAAGVSPGTGGREGAEWRAGGREGPGPSPSPSPSPAKPAGAELRRAFLERCLSSPVSAESFPGGAAAVAAFSCSVAPAAAPTPGEQFLLPLRAPFPEPALQPDPAPLSAALQSLKRAAGGERRGKAPTDCASGPAAAGIKKPKAMRKLSFADEVTTSPVLGLKIKEEEPGAPSRGLGGSRTPLGEFICQLCKEQYADPFALAQHRCSRIVRVEYRCPECDKVFSCPANLASHRRWHKPRPAAANAATVSSADGKPPSSSSSSSRDSGAIASFLAEGKENSRIERTADQHPQARDSSGADQHPDSAPRQGLQVLTHPEPPLPQGPYTEGVLGRRVPVPGSTSGGRGSEIFVCPYCHKKFRRQAYLRKHLSTHEAGSARALAPGFGSERGAPLAFACPLCGAHFPTADIREKHRLWHAVREELLLPALAGAPPETSGPSGPSDGSAQQIFSCKHCPSTFFSSPGLTRHINKCHPSESRQVLLLQMPLRPGC

SEQ ID NO: 15169 - protein, 325 aa, Homo Sapiens
MPITRMRMRPWLEMQINSNQIPGLIWINKEEMIFQIPWKHAAKHGWDINKDACLFRSWAIHTGRYKAGEKEPDPKTWKANFRCAMNSLPDIEEVKDQSRNKGSSAVRVYRMLPPLTKNQRKERKSKSSRDAKSKAKRKSCGDSSPDTFSDGLSSSTLPDDHSSYTVPGYMQDLEVEQALTPALSPCAVSSTLPDWHIPVEVVPDSTSDLYNFQVSPMPSTSEATTDEDEEGKLPEDIMKLLEQSEWQPTNVDGKGYLLNEPGVQPTSVYGDFSCKEEPEIDSPGGDIGLSLQRVFTDLKNMDATWLDSLLTPVRLPSIQAIPCAP

SEQ ID NO: 15170 - protein, 349 aa, Homo Sapiens
MPVERMRMRPWLEEQINSNTIPGLKWLNKEKKIFQIPWMHAARHGWDVEKDAPLFRNWAIHTGKHQPGVDKPDPKTWKANFRCAMNSLPDIEEVKDKSIKKGNNAFRVYRMLPLSERPSKKGKKPKTEKEDKVKHIKQEPVESSLGLSNGVSDLSPEYAVLTSTIKNEVDSTVNIIVVGQSHLDSNIENQEIVTNPPDICQVVEVTTESDEQPVSMSELYPLQISPVSSYAESETTDSVPSDEESAEGRPHWRKRNIEGKQYLSNMGTRGSYLLPGMASFVTSNKPDLQVTIKEESNPVPYNSSWPPFQDLPLSSSMTPASSSSRPDRETRASVIKKTSDITQARVKSC

SEQ ID NO: 15171 - protein, 427 aa, Homo Sapiens
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVDLITFTEGSGRSPRYALWFCVGESWPQDQPWTKRLVMVKVVPTCLRALVEMARVGGASSLENTVDLHISNSHPLSLTSDQYKAYLQDLVEGMDFQGPGES

SEQ ID NO: 15172 - protein, 451 aa, Homo Sapiens
MNLEGGGRGGEFGMSAVSCGNGKLRQWLIDQIDSGKYPGLVWENEEKSIFRIPWKHAGKQDYNREEDAALFKAWALFKGKFREGIDKPDPPTWKTRLRCALNKSNDFEELVERSQLDISDPYKVYRIVPEGAKKGAKQLTLEDPQMSMSHPYTMTTPYPSLPAQQVHNYMMPPLDRSWRDYVPDQPHPEIPYQCPMTFGPRGHHWQGPACENGCQVTGTFYACAPPESQAPGVPTEPSIRSAEALAFSDCRLHICLYYREILVKELTTSSPEGCRISHGHTYDASNLDQVLFPYPEDNGQRKNIEKLLSHLERGVVLWMAPDGLYAKRLCQSRIYWDGPLALCNDRPNKLERDQTCKLFDTQQFLSELQAFAHHGRSLPRFQVTLCFGEEFPDPQRQRKLITAHVEPLLARQLYYFAQQNSGHFLRGYDLPEHISNPEDYHRSIRHSSIQE

SEQ ID NO: 15173 - protein, 498 aa, Homo Sapiens
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEELQRMLPSLSLTEDVKWPPTLQPPTLRPPTLQPPTLQPPVVLGPPAPDPSPLAPPPGNPAGFRELLSEVLEPGPLPASLPPAGEQLLPDLLISPHMLPLTDLEIKFQYRGRPPRALTISNPHGCRLFYSQLEATQEQVELFGPISLEQVRFPSPEDIPSDKQRFYTNQLLDVLDRGLILQLQGQDLYAIRLCQCKVFWSGPCASAHDSCPNPIQREVKTKLFSLEHFLNELILFQKGQTNTPPPFEIFFCFGEEWPDRKPREKKLITVQVVPVAARLLLEMFSGELSWSADSIRLQISNPDLKDRMVEQFKELHHIWQSQQRLQPVAQAPPGAGLGVGQGPWPMHPAGMQ

SEQ ID NO: 15174 - protein, 467 aa, Homo Sapiens
MALHPRRVRLKPWLVAQVDSGLYPGLIWLHRDSKRFQIPWKHATRHSPQQEEENTIFKAWAVETGKYQEGVDDPDPAKWKAQLRCALNKSREFNLMYDGTKEVPMNPVKIYQVCDIPQPQGSIINPGSTGSAPWDEKDNDVDEEDEEDELDQSQHHVPIQDTFPFLNINGSPMAPASVGNCSVGNCSPEAVWPKTEPLEMEVPQAPIQPFYSSPELWISSLPMTDLDIKFQYRGKEYGQTMTVSNPQGCRLFYGDLGPMPDQEELFGPVSLEQVKFPGPEHITNEKQKLFTSKLLDVMDRGLILEVSGHAIYAIRLCQCKVYWSGPCAPSLVAPNLIERQKKVKLFCLETFLSDLIAHQKGQIEKQPPFEIYLCFGEEWPDGKPLERKLILVQVIPVVARMIYEMFSGDFTRSFDSGSVRLQISTPDIKDNIVAQLKQLYRILQTQESWQPMQPTPSMQLPPALPPQ

SEQ ID NO: 15175 - protein, 503 aa, Homo Sapiens
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 15176 - protein, 426 aa, Homo Sapiens
MCDRNGGRRLRQWLIEQIDSSMYPGLIWENEEKSMFRIPWKHAGKQDYNQEVDASIFKAWAVFKGKFKEGDKAEPATWKTRLRCALNKSPDFEEVTDRSQLDISEPYKVYRIVPEEEQKCKLGVATAGCVNEVTEMECGRSEIDELIKEPSVDDYMGMIKRSPSPPEACRSQLLPDWWAQQPSTGVPLVTGYTTYDAHHSAFSQMVISFYYGGKLVGQATTTCPEGCRLSLSQPGLPGTKLYGPEGLELVRFPPADAIPSERQRQVTRKLFGHLERGVLLHSSRQGVFVKRLCQGRVFCSGNAVVCKGRPNKLERDEVVQVFDTSQFFRELQQFYNSQGRLPDGRVVLCFGEEFPDMAPLRSKLILVQIEQLYVRQLAEEAGKSCGAGSVMQAPEEPPPDQVFRMFPDICASHQRSFFRENQQITV

SEQ ID NO: 15177 - protein, 393 aa, Homo Sapiens
MASGRARCTRKLRNWVVEQVESGQFPGVCWDDTAKTMFRIPWKHAGKQDFREDQDAAFFKAWAIFKGKYKEGDTGGPAVWKTRLRCALNKSSEFKEVPERGRMDVAEPYKVYQLLPPGIVSGQPGTQKVPSKRQHSSVSSERKEEEDAMQNCTLSPSVLQDSLNNEEEGASGGAVHSDIGSSSSSSSPEPQEVTDTTEAPFQGDQRSLEFLLPPEPDYSLLLTFIYNGRVVGEAQVQSLDCRLVAEPSGSESSMEQVLFPKPGPLEPTQRLLSQLERGILVASNPRGLFVQRLCPIPISWNAPQAPPGPGPHLLPSNECVELFRTAYFCRDLVRYFQGLGPPPKFQVTLNFWEESHGSSHTPQNLITVKMEQAFARYLLEQTPEQQAAILSLV

SEQ ID NO: 15178 - protein, 480 aa, Homo Sapiens
MSFPQLGYPQYLSAAGPGAYGGERPGVLAAAAAAAAAASSGRPGAAELGGGAGAAAVTSVLGMYAAAGPYAGAPNYSAFLPYAADLSLFSQMGSQYELKDNPGVHPATFAAHTAPAYYPYGQFQYGDPGRPKNATRESTSTLKAWLNEHRKNPYPTKGEKIMLAIITKMTLTQVSTWFANARRRLKKENKVTWGARSKDQEDGALFGSDTEGDPEKAEDDEEIDLESIDIDKIDEHDGDQSNEDDEDKAEAPHAPAAPSALARDQGSPLAAADVLKPQDSPLGLAKEAPEPGSTRLLSPGAAAGGLQGAPHGKPKIWSLAETATSPDGAPKASPPPPAGHPGAHGPSAGAPLQHPAFLPSHGLYTCHIGKFSNWTNSAFLAQGSLLNMRSFLGVGAPHAAPHGPHLPAPPPPQPPVAIAPGALNGDKASVRSSPTLPERDLVPRPDSPAQQLKSPFQPVRDNSLAPQEGTPRILAALPSA

SEQ ID NO: 15179 - protein, 471 aa, Homo Sapiens
MSYPQGYLYQAPGSLALYSCPAYGASALAAPRSEELARSASGSAFSPYPGSAAFTAQAATGFGSPLQYSADAAAAAAGFPSYMGAPYDAHTTGMTGAISYHPYGSAAYPYQLNDPAYRKNATRDATATLKAWLNEHRKNPYPTKGEKIMLAIITKMTLTQVSTWFANARRRLKKENKMTWAPRNKSEDEDEDEGDATRSKDESPDKAQEGTETSAEDEGISLHVDSLTDHSCSAESDGEKLPCRAGDPLCESGSECKDKYDDLEDDEDDDEEGERGLAPPKPVTSSPLTGLEAPLLSPPPEAAPRGGRKTPQGSRTSPGAPPPASKPKLWSLAEIATSDLKQPSLGPGCGPPGLPAAAAPASTGAPPGGSPYPASPLLGRPLYYTSPFYGNYTNYGNLNAALQGQGLLRYNSAAAAPGEALHTAPKAASDAGKAGAHPLESHYRSPGGGYEPKKDASEGCTVVGGGVQPYL

SEQ ID NO: 15180 - protein, 501 aa, Homo Sapiens
MSFPQLGYQYIRPLYPSERPGAAGGSGGSAGARGGLGAGASELNASGSLSNVLSSVYGAPYAAAAAAAAAQGYGAFLPYAAELPIFPQLGAQYELKDSPGVQHPAAAAAFPHPHPAFYPYGQYQFGDPSRPKNATRESTSTLKAWLNEHRKNPYPTKGEKIMLAIITKMTLTQVSTWFANARRRLKKENKMTWAPRSRTDEEGNAYGSEREEEDEEEDEEDGKRELELEEEELGGEEEDTGGEGLADDDEDEEIDLENLDGAATEPELSLAGAARRDGDLGLGPISDSKNSDSEDSSEGLEDRPLPVLSLAPAPPPVAVASPSLPSPPVSLDPCAPAPAPASALQKPKIWSLAETATSPDNPRRSPPGAGGSPPGAAVAPSALQLSPAAAAAAAHRLVSAPLGKFPAWTNRPFPGPPPGPRLHPLSLLGSAPPHLLGLPGAAGHPAAAAAFARPAEPEGGTDRCSALEVEKKLLKTAFQPVPRRPQNHLDAALVLSALSSS

SEQ ID NO: 15181 - protein, 519 aa, Homo Sapiens
MSYPQFGYPYSSAPQFLMATNSLSTCCESGGRTLADSGPAASAQAPVYCPVYESRLLATARHELNSAAALGVYGGPYGGSQGYGNYVTYGSEASAFYSLNSFDSKDGSGSAHGGLAPAAAAYYPYEPALGQYPYDRYGTMDSGTRRKNATRETTSTLKAWLQEHRKNPYPTKGEKIMLAIITKMTLTQVSTWFANARRRLKKENKMTWPPRNKCADEKRPYAEGEEEEGGEEEAREEPLKSSKNAEPVGKEEKELELSDLDDFDPLEAEPPACELKPPFHSLDGGLERVPAAPDGPVKEASGALRMSLAAGGGAALDEDLERARSCLRSAAAGPEPLPGAEGGPQVCEAKLGFVPAGASAGLEAKPRIWSLAHTATAAAAAATSLSQTEFPSCMLKRQGPAAPAAVSSAPATSPSVALPHSGALDRHQDSPVTSLRNWVDGVFHDPILRHSTLNQAWATAKGALLDPGPLGRSLGAGANVLTAPLARAFPPAVPQDAPAAGAARELLALPKAGGKPFCA

SEQ ID NO: 15182 - protein, 483 aa, Homo Sapiens
MSYPQGYLYQPSASLALYSCPAYSTSVISGPRTDELGRSSSGSAFSPYAGSTAFTAPSPGYNSHLQYGADPAAAAAAAFSSYVGSPYDHTPGMAGSLGYHPYAAPLGSYPYGDPAYRKNATRDATATLKAWLNEHRKNPYPTKGEKIMLAIITKMTLTQVSTWFANARRRLKKENKMTWTPRNRSEDEEEEENIDLEKNDEDEPQKPEDKGDPEGPEAGGAEQKAASGCERLQGPPTPAGKETEGSLSDSDFKEPPSEGRLDALQGPPRTGGPSPAGPAAARLAEDPAPHYPAGAPAPGPHPAAGEVPPGPGGPSVIHSPPPPPPPAVLAKPKLWSLAEIATSSDKVKDGGGGNEGSPCPPCPGPIAGQALGGSRASPAPAPSRSPSAQCPFPGGTVLSRPLYYTAPFYPGYTNYGSFGHLHGHPGPGPGPTTGPGSHFNGLNQTVLNRADALAKDPKMLRSQSQLDLCKDSPYELKKGMSDI

SEQ ID NO: 15183 - protein, 446 aa, Homo Sapiens
MSFPHFGHPYRGASQFLASASSSTTCCESTQRSVSDVASGSTPAPALCCAPYDSRLLGSARPELGAALGIYGAPYAAAAAAQSYPGYLPYSPEPPSLYGALNPQYEFKEAAGSFTSSLAQPGAYYPYERTLGQYQYERYGAVELSGAGRRKNATRETTSTLKAWLNEHRKNPYPTKGEKIMLAIITKMTLTQVSTWFANARRRLKKENKMTWAPKNKGGEERKAEGGEEDSLGCLTADTKEVTASQEARGLRLSDLEDLEEEEEEEEEAEDEEVVATAGDRLTEFRKGAQSLPGPCAAAREGRLERRECGLAAPRFSFNDPSGSEEADFLSAETGSPRLTMHYPCLEKPRIWSLAHTATASAVEGAPPARPRPRSPECRMIPGQPPASARRLSVPRDSACDESSCIPKAFGNPKFALQGLPLNCAPCPRRSEPVVQCQYPSGAEAG

SEQ ID NO: 15184 - protein, 349 aa, Homo Sapiens
MGDMGDPPKKKRLISLCVGCGNQIHDQYILRVSPDLEWHAACLKCAECNQYLDESCTCFVRDGKTYCKRDYIRLYGIKCAKCSIGFSKNDFVMRARSKVYHIECFRCVACSRQLIPGDEFALREDGLFCRADHDVVERASLGAGDPLSPLHPARPLQMAAEPISARQPALRPHVHKQPEKTTRVRTVLNEKQLHTLRTCYAANPRPDALMKEQLVEMTGLSPRVIRVWFQNKRCKDKKRSIMMKQLQQQQPNDKTNIQGMTGTPMVAASPERHDGGLQANPVEVQSYQPPWKVLSDFALQSDIDQPAFQQLVNFSEGGPGSNSTGSEVASMSSQLPDTPNSMVASPIEA

SEQ ID NO: 15185 - protein, 359 aa, Homo Sapiens
MVDIIFHYPFLGAMGDHSKKKPGTAMCVGCGSQIHDQFILRVSPDLEWHAACLKCAECSQYLDETCTCFVRDGKTYCKRDYVRLFGIKCAKCQVGFSSSDLVMRARDSVYHIECFRCSVCSRQLLPGDEFSLREHELLCRADHGLLLERAAAGSPRSPGPLPGARGLHLPDAGSGRQPALRPHVHKQTEKTTRVRTVLNEKQLHTLRTCYAANPRPDALMKEQLVEMTGLSPRVIRVWFQNKRCKDKKKSILMKQLQQQQHSDKTSLQGLTGTPLVAGSPIRHENAVQGSAVEVQTYQPPWKALSEFALQSDLDQPAFQQLVSFSESGSLGNSSGSDVTSLSSQLPDTPNSMVPSPVET

SEQ ID NO: 15186 - protein, 245 aa, Homo Sapiens
MCAEVGPALCRGMERNSLGCCEAPKKLSLSFSIEAILKRPARRSDMDRPEGPGEEGPGEAAASGSGLEKPPKDQPQEGRKSKRRVRTTFTTEQLHELEKIFHFTHYPDVHIRSQLAARINLPEARVQIWFQNQRAKWRKQEKIGNLGAPQQLSEASVALPTNLDVAGPTWTSTALRRLAPPTSCCPSAQDQLASAWFPAWITLLPAHPWETQPVPGLPIHQTCIPVLCILPPPHPKWGSICATST

SEQ ID NO: 15187 - protein, 1246 aa, Homo Sapiens [sequence omitted]

SEQ ID NO: 15188 - protein, 243 aa, Homo Sapiens
MTGIAAASFFSNTCRFGGCGLHFPTLADLIEHIEDNHIDTDPRVLEKQELQQPTYVALSYINRFMTDAARREQESLKKKIQPKLSLTLSSSVSRGNVSTPPRHSSGSLTPPVTPPITPSSSFRSSTPTGSEYDEEEVDYEESDSDESWTTESAISSEAILSSMCMNGGEEKPFACPVPGCKKRYKNVNGIKYHAKNGHRTQIRVRKPFKCRCGKSYKTAQGLRHHTINFHPPVSAEIIRKMQQ

SEQ ID NO: 15189 - protein, 163 aa, Homo Sapiens
MMPGQIPDPSVTTGSLPGLGPLTGLPSSALTVEELKYADIRNLGAMIAPLHFLEVKLGKRPQPVKSELDEEEERRKRRREKNKVAAARCRNKKKERTEFLQRESERLELMNAELKTQIEELKQERQQLILMLNRHRPTCIVRTDSVKTPESEGNPLLEQLEKK

SEQ ID NO: 15190 - protein, 331 aa, Homo Sapiens
MTAKMETTFYDDALNASFLPSESGPYGYSNPKILKQSMTLNLADPVGSLKPHLRAKNSDLLTSPDVGLLKLASPELERLIIQSSNGHITTTPTPTQFLCPKNVTDEQEGFAEGFVRALAELHSQNTLPSVTSAAQPVNGAGMVAPAVASVAGGSGSGGFSASLHSEPPVYANLSNFNPGALSSGGGAPSYGAAGLAFPAQPQQQQQPPHHLPQQMPVQHPRLQALKEEPQTVPEMPGETPPLSPIDMESQERIKAERKRMRNRIAASKCRKRKLERIARLEEKVKTLKAQNSELASTANMLREQVAQLKQKVMNHVNSGCQLMLTQQLQTF

SEQ ID NO: 15191 - protein, 347 aa, Homo Sapiens
MCTKMEQPFYHDDSYTATGYGRAPGGLSLHDYKLLKPSLAVNLADPYRSLKAPGARGPGPEGGGGGSYFSGQGSDTGASLKLASSELERLIVPNSNGVITTTPTPPGQYFYPRGGGSGGGAGGAGGGVTEEQEGFADGFVKALDDLHKMNHVTPPNVSLGATGGPPAGPGGVYAGPEPPPVYTNLSSYSPASASSGGAGAAVGTGSSYPTTTISYLPHAPPFAGGHPAQLGLGRGASTFKEEPQTVPEARSRDATPPVSPINMEDQERIKVERKRLRNRLAATKCRKRKLERIARLEDKVKTLKAENAGLSSTAGLLREQVAQLKQKVMTHVSNGCQLLLGVKGHAF

SEQ ID NO: 15192 - protein, 347 aa, Homo Sapiens
METPFYGDEALSGLGGGASGSGGSFASPGRLFPGAPPTAAAGSMMKKDALTLSLSEQVAAALKPAAAPPPTPLRADGAPSAAPPDGLLASPDLGLLKLASPELERLIIQSNGLVTTTPTSSQFLYPKVAASEEQEFAEGFVKALEDLHKQNQLGAGAAAAAAAAAAGGPSGTATGSAPPGELAPAAAAPEAPVYANLSSYAGGAGGAGGAATVAFAAEPVPFPPPPPPGALGPPRLAALKDEPQTVPDVPSFGESPPLSPIDMDTQERIKAERKRLRNRIAASKCRKRKLERISRLEEKVKTLKSQNTELASTASLLREQVAQLKQKVLSHVNSGCQLLPQHQVPAY

SEQ ID NO: 15193 - protein, 513 aa, Homo Sapiens
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 15194 - protein, 2004 aa, Homo Sapiens
MVKLANPLYTEWILEAIKKVKKQKQRPSEERICNAVSSSHGLDRKTVLEQLELSVKDGTILKVSNKGLNSYKDPDNPGRIALPKPRNHGKLDNKQNVDWNKLIKRAVEGLAESGGSTLKSIERFLKGQKDVSALFGGSAASGFHQQLRLAIKRAIGHGRLLKDGPLYRLNTKATNVDGKESCESLSCLPPVSLLPHEKDKPVAEPIPICSFCLGTKEQNREKKPEELISCADCGNSGHPSCLKFSPELTVRVKALRWQCIECKTCSSCRDQGKNADNMLFCDSCDRGFHMECCDPPLTRMPKGMWICQICRPRKKGRKLLQKKAAQIKRRYTNPIGRPKNRLKKQNTVSKGPFSKVRTGPGRGRKRKITLSSQSASSSSEEGYLERIDGLDFCRDSNVSLKFNKKTKGLIDGLTKFFTPSPDGRKARGEVVDYSEQYRIRKRGNRKSSTSDWPTDNQDGWDGKQENEERLFGSQEIMTEKDMELFRDIQEQALQKVGVTGPPDPQVRCPSVIEFGKYEIHTWYSSPYPQEYSRLPKLYLCEFCLKYMKSRTILQQHMKKCGWFHPPANEIYRKNNISVFEVDGNVSTIYCQNLCLLAKLFLDHKTLYYDVEPFLFYVLTQNDVKGCHLVGYFSKEKHCQQKYNVSCIMILPQYQRKGYGRFLIDFSYLLSKREGQAGSPEKPLSDLGRLSYMAYWKSVILECLYHQNDKQISIKKLSKLTGICPQDITSTLHHLRMLDFRSDQFVIIRREKLIQDHMAKLQLNLRPVDVDPECLRWTPVIVSNSVVSEEEEEEAEEGENEEPQCQERELEISVGKSVSHENKEQDSYSVESEKKPEVMAPVSSTRLSKQVLPHDSLPANSQPSRRGRWGRKNRKTQERFGDKDSKLLLEETSSAPQEQYGECGEKSEATQEQYTESEEQLVASEEQPSQDGKPDLPKRRLSEGVEPWRGQLKKSPEALKCRLTEGSERLPRRYSEGDRAVLRGFSESSEEEEEPESPRSSSPPILTKPTLKRKKPFLHRRRRVRKRKHHNSSVVTETISETTEVLDEPFEDSDSERPMPRLEPTFEIDEEEEEEDENELFPREYFRRLSSQDVLRCQSSSKRKSKDEEEDEESDDADDTPILKPVSLLRKRDVKNSPLEPDTSTPLKKKKGWPKGKSRKPIHWKKRPGRKPGFKLSREIMPVSTQACVIEPIVSIPKAGRKPKIQESEETVEPKEDMPLPEERKEEEEMQAEAEEAEEGEEEDAASSEVPAASPADSSNSPETETKEPEVEEEEEKPRVSEEQRQSEEEQQELEEPEPEEEEDAAAETAQNDDHDADDEDDGHLESTKKKELEEQPTREDVKEEPGVQESFLDANMQKSREKIKDKEETELDSEEEQPSHDTSVVSEQMAGSEDDHEEDSHTKEELIELKEEEEIPHSELDLETVQAVQSLTQEESSEHEGAYQDCEETLAACQTLQSYTQADEDPQMSMVEDCHASEHNSPISSVQSHPSQSVRSVSSPNVPALESGYTQISPEQGSLSAPSMQNMETSPMMDVPSVSDHSQQVVDSGFSDLGSIESTTENYENPSSYDSTMGGSICGNSSSQSSCSYGGLSSSSSLTQSSCVVTQQMASMGSSCSMMQQSSVQPAANCSIKSPQSCVVERPPSNQQQQPPPPPPQQPQPPPPQPQPAPQPPPPQQQPQQQPQPQPQQPPPPPPPQQQPPLSQCSMNNSFTPAPMIMEIPESGSTGNISIYERIPGDFGAGSYSQPSATFSLAKLQQLTNTIMDPHAMPYSHSPAVTSYATSVSLSNTGLAQLAPSHPLAGTPQAQATMTPPPNLASTTMNLTSPLLQCNMSATNIGIPHTQRLQGQMPVKGHISIRSKSAPLPSAAAHQQQLYGRSPSAVAMQAGPRALAVQRGMNMGVNLMPTPAYNVNSMNMNTLNAMNSYRMTQPMMNSSYHSNPAYMNQTAQYPMQMQMGMMGSQAYTQQPMQPNPHGNMMYTGPSHHSYMNAAGVPKQSLNGPYMRR

SEQ ID NO: 15195 - protein, 2073 aa, Homo Sapiens
MVKLANPLYTEWILEAIQKIKKQKQRPSEERICHAVSTSHGLDKKTVSEQLELSVQDGSVLKVTNKGLASYKDPDNPGRFSSVKPGTFPKSAKGSRGSCNDLRNVDWNKLLRRAIEGLEEPNGSSLKNIEKYLRSQSDLTSTTNNPAFQQRLRLGAKRAVNNGRLLKDGPQYRVNYGSLDGKGAPQYPSAFPSSLPPVSLLPHEKDQPRADPIPICSFCLGTKESNREKKPEELLSCADCGSSGHPSCLKFCPELTTNVKALRWQCIECKTCSACRVQGRNADNMLFCDSCDRGFHMECCDPPLSRMPKGMWICQVCRPKKKGRKLLHEKAAQIKRRYAKPIGRPKNKLKQRLLSVTSDEGSMNAFTGRGSPGRGQKTKVCTTPSSGHAASGKDSSSRLAVTDPTRPGATTKITTTSTYISASTLKVNKKTKGLIDGLTKFFTPSPDGRRSRGEIIDFSKHYRPRKKVSQKQSCTSHVLATGTTQKLKPPPSSLPPPTPISGQSPSSQKSSTATSSPSPQSSSSQCSVPSLSSLTTNSQLKALFDGLSHIYTTQGQSRKKGHPSYAPPKRMRRKTELSSTAKSKAHFFGKRDIRSRFISHSSSSSWGMARGSIFKAIAHFKRTTFLKKHRMLGRLKYKVTPQMGTPSPGKGSLTDGRIKPDQDDDTEIKINIKQESADVNVIGNKDVVTEEDLDVFKQAQELSWEKIECESGVEDCGRYPSVIEFGKYEIQTWYSSPYPQEYARLPKLYLCEFCLKYMKSKNILLRHSKKCGWFHPPANEIYRRKDLSVFEVDGNMSKIYCQNLCLLAKLFLDHKTLYYDVEPFLFYVLTKNDEKGCHLVGYFSKEKLCQQKYNVSCIMIMPQHQRQGFGRFLIDFSYLLSRREGQAGSPEKPLSDLGRLSYLAYWKSVILEYLYHHHERHISIKAISRATGMCPHDIATTLQHLHMIDKRDGRFVIIRREKLILSHMEKLKTCSRANELDPDSLRWTPILISNAAVSEEEREAEKEAERLMEQASCWEKEEQEILSTRANSRQSPAKVQSKNKYLHSPESRPVTGERGQLLELSKESSEEEEEEEDEEEEEEEEEEEEDEEEEEEEEEEEEEENIQSSPPRLTKPQSVAIKRKRPFVLKKKRGRKRRRINSSVTTETISETTEVLNEPFDNSDEERPMPQLEPTCEIEVEEDGRKPVLRKAFQHQPGKKRQTEEEEGKDNHCFKNADPCRNNMNDDSSNLKEGSKDNPEPLKCKQVWPKGTKRGLSKWRQNKERKTGFKLNLYTPPETPMEPDEQVTVEEQKETSEGKTSPSPIRIEEEVKETGEALLPQEENRREETCAPVSPNTSPGEKPEDDLIKPEEEEEEEEEEEEEEEEEEGEEEEGGGNVEKDPDGAKSQEKEEPEISTEKEDSARLDDHEEEEEEDEEPSHNEDHDADDEDDSHMESAEVEKEELPRESFKEVLENQETFLDLNVQPGHSNPEVLMDCGVDLTASCNSEPKELAGDPEAVPESDEEPPPGEQAQKQDQKNSKEVDTEFKEGNPATMEIDSETVQAVQSLTQESSEQDDTFQDCAETQEACRSLQNYTRADQSPQIATTLDDCQQSDHSSPVSSVHSHPGQSVRSVNSPSVPALENSYAQISPDQSAISVPSLQNMETSPMMDVPSVSDHSQQVVDSGFSDLGSIESTTENYENPSSYDSTMGGSICGNGSSQNSCSYSNLTSSSLTQSSCAVTQQMSNISGSCSMLQQTSISSPPTCSVKSPQGCVVERPPSSSQQLAQCSMAANFTPPMQLAEIPETSNANIGLYERMGQSDFGAGHYPQPSATFSLAKLQQLTNTLIDHSLPYSHSAAVTSYANSASLSTPLSNTGLVQLSQSPHSVPGGPQAQATMTPPPNLTPPPMNLPPPLLQRNMAASNIGISHSQRLQTQIASKGHISMRTKSASLSPAAATHQSQIYGRSQTVAMQGPARTLTMQRGMNMSVNLMPAPAYNVNSVNMNMNTLNAMNGYSMSQPMMNSGYHSNHGYMNQTPQYPMQMQMGMMGTQPYAQQPMQTPPHGNMMYTAPGHHGYMNTGMSKQSLNGSYMRR

SEQ ID NO: 15196 - protein, 611 aa, Homo Sapiens
MPRRKRNAGSSSDGTEDSDFSTDLEHTDSSESDGTSRRSARVTRSSARLSQSSQDSSPVRNLQSFGTEEPAYSTRRVTRSQQQPTPVTPKKYPLRQTRSSGSETEQVVDFSDRETKNTADHDESPPRTPTGNAPSSESDIDISSPNVSHDESIAKDMSLKDSGSDLSHRPKRRRFHESYNFNMKCPTPGCNSLGHLTGKHERHFSISGCPLYHNLSADECKVRAQSRDKQIEERMLSHRQDDNNRHATRHQAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 15197 - protein, 458 aa, Homo Sapiens
MAAQGAAAAVAAGTSGVAGEGEPGPGENAAAEGTAPSPGRVSPPTPARGEPEVTVEIGETYLCRRPDSTWHSAEVIQSRVNDQEGREEFYVHYVGFNRRLDEWVDKNRLALTKTVKDAVQKNSEKYLSELAEQPERKITRNQKRKHDEINHVQKTYAEMDPTTAALEKEHEAITKVKYVDKIHIGNYEIDAWYFSPFPEDYGKQPKLWLCEYCLKYMKYEKSYRFHLGQCQWRQPPGKEIYRKSNISVYEVDGKDHKIYCQNLCLLAKLFLDHKTLYFDVEPFVFYILTEVDRQGAHIVGYFSKEKESPDGNNVACILTLPPYQRRGYGKFLIAFSYELSKLESTVGSPEKPLSDLGKLSYRSYWSWVLLEILRDFRGTLSIKDLSQMTSITQNDIISTLQSLNMVKYWKGQHVICVTPKLVEEHLKSAQYKKPPITVDSVCLKWAPPKHKQVKLSKK

SEQ ID NO: 15198 - protein, 381 aa, Homo Sapiens
MSRHEGVSCDACLKGNFRGRRYKCLICYDYDLCASCYESGATTTRHTTDHPMQCILTRVDFDLYYGGEAFSVEQPQSFTCPYCGKMGYTETSLQEHVTSEHAETSTEVICPICAALPGGDPNHVTDDFAAHLTLEHRAPRDLDESSGVRHVRRMFHPGRGLGGPRARRSNMHFTSSSTGGLSSSQSSYSPSNREAMDPIAELLSQLSGVRRSAGGQLNSSGPSASQLQQLQMQLQLERQHAQAARQQLETARNATRRTNTSSVTTTITQSTATTNIANTESSQQTLQNSQFLLTRLNDPKMSETERQSMESERADRSLFVQELLLSTLVREESSSSDEDDRGEMADFGAMGCVDIMPLDVALENLNLKESNKGNEPPPPPL

SEQ ID NO: 15199 - protein, 256 aa, Homo Sapiens; identical to SEQ ID NO: 7382

SEQ ID NO: 15200 - protein, 1162 aa, Homo Sapiens
MEPEEERIRYSQRLRGTMRRRYEDDGISDDEIEGKRTFDLEEKLHTNKYNANFVTFMEGKDFNVEYIQRGGLRDPLIFKNSDGLGIKMPDPDFTVNDVKMCVGSRRMVDVMDVNTQKGIEMTMAQWTRYYETPEEEREKLYNVISLEFSHTRLENMVQRPSTVDFIDWVDNMWPRHLKESQTESTNAILEMQYPKVQKYCLMSVRGCYTDFHVDFGGTSVWYHIHQGGKVFWLIPPTAHNLELYENWLLSGKQGDIFLGDRVSDCQRIELKQGYTFVIPSGWIHAVYTPTDTLVFGGNFLHSFNIPMQLKIYNIEDRTRVPNKFRYPFYYEMCWYVLERYVYCITNRSHLTKEFQKESLSMDLELNGLESGNGDEEAVDREPRRLSSRRSVLTSPVANGVNLDYDGLGKTCRSLPSLKKTLAGDSSSDCSRGSHNGQVWDPQCAPRKDRQVHLTHFELEGLRCLVDKLESLPLHKKCVPTGIEDEDALIADVKILLEELANSDPKLALTGVPIVQWPKRDKLKFPTRPKVRVPTIPITKPHTMKPAPRLTPVRPAAASPIVSGARRRRVRCRKCKACVQGECGVCHYCRDMKKFGGPGRMKQSCVLRQCLAPRLPHSVTCSLCGEVDQNEETQDFEKKLMECCICNEIVHPGCLQMDGEGLLNEELPNCWECPKCYQEDSSEKAQKRKMEESDEEAVQAKVLRPLRSCDEPLTPPPHSPTSMLQLIHDPVSPRGMVTRSSPGAGPSDHHSASRDERFKRRQLLRLQATERTMVREKENNPSGKKELSEVEKAKIRGSYLTVTLQRPTKELHGTSIVPKLQAITASSANLRHSPRVLVQHCPARTPQRGDEEGLGGEEEEEEEEEEEDDSAEEGGAARLNGRGSWAQDGDESWMQREVWMSVFRYLSRRELCECMRVCKTWYKWCCDKRLWTKIDLSRCKAIVPQALSGIIKRQPVSLDLSWTNISKKQLTWLVNRLPGLKDLLLAGCSWSAVSALSTSSCPLLRTLDLRWAVGIKDPQIRDLLTPPADKPGQDNRSKLRNMTDFRLAGLDITDATLRLIIRHMPLLSRLDLSHCSHLTDQSSNLLTAVGSSTRYSLTELNMAGCNKLTDQTLIYLRRIANVTLIDLRGCKQITRKACEHFISDLSINSLYCLSDEKLIQKIS

SEQ ID NO: 15201 - protein, 1690 aa, Homo Sapiens
MAGVGPGGYAAEFVPPPECPVFEPSWEEFTDPLSFIGRIRPLAEKTGICKIRPPKDWQPPFACEVKSFRFTPRVQRLNELEAMTRVRLDFLDQLAKFWELQGSTLKIPVVERKILDLYALSKIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHRQSPDSGRTRTKLTVEELKAFVQQLFSLPCVISQARQVKNLLDDVEEFHERAQEAMMDETPDSSKLQMLIDMGSSLYVELPELPRLKQELQQARWLDEVRLTLSDPQQVTLDVMKKLIDSGVGLAPHHAVEKAMAELQELLTVSERWEEKAKVCLQARPRHSVASLESIVNEAKNIPAFLPNVLSLKEALQKAREWTAKVEAIQSGSNYAYLEQLESLSAKGRPIPVRLEALPQVESQVAAARAWRERTGRTFLKKNSSHTLLQVLSPRTDIGVYGSGKNRRKKVKELIEKEKEKDLDLEPLSDLEEGLEETRDTAMVVAVFKEREQKEIEAMHSLRAANLAKMTMVDRIEEVKFCICRKTASGFMLQCELCKDWFHNSCVPLPKSSSQKKGSSWQAKEVKFLCPLCMRSRRPRLETILSLLVSLQKLPVRLPEGEALQCLTERAMSWQDRARQALATDELSSALAKLSVLSQRMVEQAAREKTEKIISAELQKAAANPDLQGHLPSFQQSAFNRVVSSVSSSPRQTMDYDDEETDSDEDIRETYGYDMKDTASVKSSSSLEPNLFCDEEIPIKSEEVVTHMWTAPSFCAEHAYSSASKSCSQGSSTPRKQPRKSPLVPRSLEPPVLELSPGAKAQLEELMMVGDLLEVSLDETQHIWRILQATHPPSEDRFLHIMEDDSMEEKPLKVKGKDSSEKKRKRKLEKVEQLFGEGKQKSKELKKMDKPRKKKLKLGADKSKELNKLAKKLAKEEERKKKKEKAAAAKVELVKESTEKKREKKVLDIPSKYDWSGAEESDDENAVCAAQNCQRPCKDKVDWVQCDGGCDEWFHQVCVGVSPEMAENEDYICINCAKKQGPVSPGPAPPPSFIMSYKLPMEDLKETS

SEQ ID NO: 15202 - protein, 1544 aa, Homo Sapiens
MEAATTLHPGPRPALPLGGPGPLGEFLPPPECPVFEPSWEEFADPFAFIHKIRPIAEQTGICKVRPPPDWQPPFACDVDKLHFTPRIQRLNELEAQTRVKLNFLDQIAKYWELQGSTLKIPHVERKILDLFQLNKLVAEEGGFAVVCKDRKWTKIATKMGFAPGKAVGSHIRGHYERILNPYNLFLSGDSLRCLQKPNLTTDTKDKEYKPHDIPQRQSVQPSETCPPARRAKRMRAEAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTPKKKKIKLSHPKDMNNFKLERERSYELVRSAETHSLPSDTSYSEQEDSEDEDAICPAVSCLQPEGDEVDWVQCDGSCNQWFHQVCVGVSPEMAEKEDYICVRCTVKDAPSRK

SEQ ID NO: 15203 - protein, 1560 aa, Homo Sapiens
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 15204 - protein, 1539 aa, Homo Sapiens
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKDVLEQVEAYQAEAREALATLPSSPGLLRSLLERGQQLGVEVPEAHQLQQQVEQAQWLDEVKQALAPSAHRGSLVIMQGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSGSSAACPSLMPLLQLSYSDEQQL

SEQ ID NO: 15205 - protein, 711 aa, Homo Sapiens
MSDYSTGGPPPGPPPPAGGGGGAGGAGGGPPPGPPGAGDRGGGGPGGGGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAPESVQKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQAQ

SEQ ID NO: 15206 - protein, 1950 aa, Homo Sapiens
MPGARRRRRGAAMEGKPRAGVALAPGPSGRRPSARCARRRRPGLLLPGLWLLLLARPASCAPDELSPEQHNLSLYSMELVLKKSTGHSAAQVALTETAPGSQHSSPLHVTAPPSATTFDTAFFNQGKQTKSTADPSIFVATYVSVTSKEVAVNDDEMDNFLPDTHWTTPRMVSPIQYITVSPPGLPREALEPMLTPSLPMVSLQDEEVTSGWQNTTRQPAAYAESASHFHTFRSAFRTSEGIVPTPGRNLVLYPTDAYSHLSSRTLPEIVASLTEGVETTLFLSSRSLMPQPLGDGITIPLPSLGEVSQPPEEVWATSADRYTDVTTVLSQSLEETISPRTYPTVTASHAALAFSRTHSPLLSTPLAFASSASPTDVSSNPFLPSDSSKTSELHSNSALPGPVDNTHILSPVSSFRPYTWCAACTVPSPQQVLATSLMEKDVGSGDGAETLCMTVLEESSISLMSSVVADFSEFEEDPQVFNTLFPSRPIVPLSSRSMEISETSVGISAEVDMSSVTTTQVPPAHGRLSVPASLDPTAGSLSVAETQVTPSSVTTAFFSVITSILLDSSFSVIANKNTPSLAVRDPSVFTPYSLVPSVESSLFSDQERSSFSEHKPRGALDFASSFFSTPPLELSGSISSPSEAPASLSLMPSDLSPFTSQSFSPLVETFTLFDSSDLQSSQLSLPSSTNLEFSQLQPSSELPLNTIMLLPSRSEVSPWSSFPSDSLEFVEASTVSLTDSEAHFTSAFIETTSYLESSLISHESAVTALVPPGSESFDILTAGIQATSPLTTVHTTPILTESSLFSTLTPPDDQISALDGHVSVLASFSKAIPTGTVLITDAYLPSGSSFVSEATPFPLPTELTVVGPSLTPTEVPLNTSTEVSTTSTGAATGGPLDSTLMGDAASQSPPESSAAPPLPSLRPVTAFTLEATVDTPTLATAKPPYVCDITVPDAYLITTVLARRAVQEYIITAIKEVLRIHFNRAVELKVYELFTDFTFLVTSGPFVYTAISVINVLINSKLVRDQTPLILSVKPSFLVPESRFQVQTVLQFVPPSVDTGFCNFTQRIEKGLMTALFEVRKHHQGTYNLTVQILNITISSSRVTPRRGPVNIIFAVKSTQGFLNGSEVSELLRNLSVVEFSFYLGYPVLQIAEPFQYPQLNLSQLLKSSWVRTVLLGVMEKQLQNEVFQAEMERKLAQLLSEVSTRRRMWRRATVAAGNSVVQVVNVSRLEGDDNPVQLIYFVEDQDGERLSAVKSSDLINKMDLQRAAIILGYRIQGVIAQPVDRVKRPSPESQSNNLWVIVGVVIPVLVVMVIVVILYWKLCRTDKLDFQPDTVANIQQRQKLQIPSVKGFDFAKQHLGQHNKDDILIIHEPAPLPGPLKDHTTPSENGDVPSPKSKIPSKNVRHRGRVSPSDADSTVSEESSERDAGDKTPGAVNDGRSHRAPQSGPPLPSSGNEQHSSASIFEHVDRISRPPEASRRVPSKIQLIAMQPIPAPPVQRPSPADRVAESNKINKEIQTALRHKSEIEHHRNKIRLRAKRRGHYEFPVVDDLSSGDTKERHRVYRRAQMQIDKILDPTASVPSVFIEPRKSSRIKRSPKPRRKHQVNGCPADAEKDRLITTDSDGTYRRPPGVHNSAYIGCPSDPDLPADVQTPSSVELGRYPALPFPASQYIPPQPSIEEARQTMHSLLDDAFALVAPSSQPASTAGVGPGVPPGLPANSTPSQEERRATQWGSFYSPAQTANNPCSRYEDYGMTPPTGPLPRPGFGPGLLQSTELVPPDPQQPQASAEAPFAARGIYSEEMPSVARPRPVGGTTGSQIQHLTQVGIASRIGAQPVEIPPSRGSQYGGPGWPSYGEDEAGRREATHMLGHQEYSSSPLFQVPRTSGREPSAPSGNLPHRGLQGPGLGYPTSSTEDLQPGHSSASLIKAIREELLRLSQKQSTVQNFHS

SEQ ID NO: 15207 - protein, 362 aa, Homo Sapiens
MATAETALPSISTLTALGPFPDTQDDFLKWWRSEEAQDMGPGPPDPTEPPLHVKSEDQPGEEEDDERGADATWDLDLLLTNFSGPEPGGAPQTCALAPSEASGAQYPPPPETLGAYAGGPGLVAGLLGSEDHSGWVRPALRARAPDAFVGPALAPAPAPEPKALALQPVYPGPGAGSSGGYFPRTGLSVPAASGAPYGLLSGYPAMYPAPQYQGHFQLFRGLQGPAPGPATSPSFLSCLGPGTVGTGLGGTAEDPGVIAETAPSKRGRRSWARKRQAAHTCAHPGCGKSYTKSSHLKAHLRTHTGEKPYACTWEGCGWRFARSDELTRHYRKHTGQRPFRCQLCPRAFSRSDHLALHMKRHL

SEQ ID NO: 15208 - protein, 480 aa, Homo Sapiens
MLNFGASLQQTAEERMEMISERPKESMYSWNKTAEKSDFEAVEALMSMSCSWKSDFKKYVENRPVTPVSDLSEEENLLPGTPDFHTIPAFCLTPPYSPSDFEPSQVSNLMAPAPSTVHFKSLSDTAKPHIAAPFKEEEKSPVSAPKLPKAQATSVIRHTADAQLCNHQTCPMKAASILNYQNNSFRRRTHLNVEAARKNIPCAAVSPNRSKCERNTVADVDEKASAALYDFSVPSSETVICRSQPAPVSPQQKSVLVSPPAVSAGGVPPMPVICQMVPLPANNPVVTTVVPSTPPSQPPAVCPPVVFMGTQVPKGAVMFVVPQPVVQSSKPPVVSPNGTRLSPIAPAPGFSPSAAKVTPQIDSSRIRSHICSHPGCGKTYFKSSHLKAHTRTHTGEKPFSCSWKGCERRFARSDELSRHRRTHTGEKKFACPMCDRRFMRSDHLTKHARRHLSAKKLPNWQMEVSKLNDIALPPTPAPTQ

SEQ ID NO: 15209 - protein, 512 aa, Homo Sapiens
MHTPDFAGPDDARAVDIMDICESILERKRHDSERSTCSILEQTDMEAVEALVCMSSWGQRSQKGDLLRIRPLTPVSDSGDVTTTVHMDAATPELPKDFHSLSTLCITPPQSPDLVEPSTRTPVSPQVTDSKACTATDVLQSSAVVARALSGGAERGLLGLEPVPSSPCRAKGTSVIRHTGESPAACFPTIQTPDCRLSDSREGEEQLLGHFETLQDTHLTDSLLSTNLVSCQPCLHKSGGLLLTDKGQQAGWPGAVQTCSPKNYENDLPRKTTPLISVSVPAPPVLCQMIPVTGQSSMLPAFLKPPPQLSVGTVRPILAQAAPAPQPVFVGPAVPQGAVMLVLPQGALPPPAPCAANVMAAGNTKLLPLAPAPVFITSSQNCVPQVDFSRRRNYVCSFPGCRKTYFKSSHLKAHLRTHTGEKPFNCSWDGCDKKFARSDELSRHRRTHTGEKKFVCPVCDRRFMRSDHLTKHARRHMTTKKIPGWQAEVGKLNRIASAESPGSPLVSMPASA

SEQ ID NO: 15210 - protein, 402 aa, Homo Sapiens
MNIHMKRKTIKNINTFENRMLMLDGMPAVRVKTELLESEQGSPNVHNYPDMEAVPLLLNNVKGEPPEDSLSVDHFQTQTEPVDLSINKARTSPTAVSSSPVSMTASASSPSSTSTSSSSSSRLASSPTVITSVSSASSSSTVLTPGPLVASASGVGGQQFLHIIHPVPPSSPMNLQSNKLSHVHRIPVVVQSVPVVYTAVRSPGNVNNTIVVPLLEDGRGHGKAQMDPRGLSPRQSKSDSDDDDLPNVTLDSVNETGSTALSIARAVQEVHPSPVSRVRGNRMNNQKFPCSISPFSIESTRRQRRSESPDSRKRRIHRCDFEGCNKVYTKSSHLKAHRRTHTGEKPYKCTWEGCTWKFARSDELTRHYRKHTGVKPFKCADCDRSFSRSDHLALHRRRHMLV

SEQ ID NO: 15211 - protein, 288 aa, Homo Sapiens
MAAAAYVDHFAAECLVSMSSRAVVHGPREGPESRPEGAAVAATPTLPRVEERRDGKDSASLFVVARILADLNQQAPAPAPAERREGAAARKARTPCRLPPPAPEPTSPGAEGAAAAPPSPAWSEPEPEAGLEPEREPGPAGSGEPGLRQRVRRGRSRADLESPQRKHKCHYAGCEKVYGKSSHLKAHLRTHTGERPFACSWQDCNKKFARSDELARHYRTHTGEKKFSCPICEKRFMRSDHLTKHARRHANFHPGMLQRRGGGSRTGSLSDYSRSDASSPTISPASSP

SEQ ID NO: 15212 - protein, 323 aa, Homo Sapiens
MSAAVACLDYFAAECLVSMSAGAVVHRRPPDPEGAGGAAGSEVGAAPPESALPGPGPPGPASVPQLPQVPAPSPGAGGAAPHLLAASVWADLRGSSGEGSWENSGEAPRASSGFSDPIPCSVQTPCSELAPASGAAAVCAPESSSDAPAVPSAPAAPGAPAASGGFSGGALGAGPAPAADQAPRRRSVTPAAKRHQCPFPGCTKAYYKSSHLKSHQRTHTGERPFSCDWLDCDKKFTRSDELARHYRTHTGEKRFSCPLCPKQFSRSDHLTKHARRHPTYHPDMIEYRGRRRTPRIDPPLTSEVESSASGSGPGPAPSFTTCL

SEQ ID NO: 15213 - protein, 416 aa, Homo Sapiens
MVDHLLPVDENFSSPKCPVGYLGDRLVGRRAYHMLPSPVSEDDSDASSPCSCSSPDSQALCSCYGGGLGTESQDSILDFLLSQATLGSGGGSGSSIGASSGPVAWGPWRRAAAPVKGEHFCLPEFPLGDPDDVPRPFQPTLEEIEEFLEENMEPGVKEVPEGNSKDLDACSQLSAGPHKSHLHPGSSGRERCSPPPGGASAGGAQGPGGGPTPDGPIPVLLQIQPVPVKQESGTGPASPGQAPENVKVAQLLVNIQGQTFALVPQVVPSSNLNLPSKFVRIAPVPIAAKPVGSGPLGPGPAGLLMGQKFPKNPAAELIKMHKCTFPGCSKMYTKSSHLKAHLRRHTGEKPFACTWPGCGWRFSRSDELSRHRRSHSGVKPYQCPVCEKKFARSDHLSKHIKVHRFPRSSRSVRSVN

SEQ ID NO: 15214 - protein, 252 aa, Homo Sapiens
MSAAVACVDYFAADVLMAISSGAVVHRGRPGPEGAGPAAGLDVRAARREAASPGTPGPPPPPPAASGPGPGAAAAPHLLAASILADLRGGPGAAPGGASPASSSSAASSPSSGRAPGAAPSAAAKSHRCPFPDCAKAYYKSSHLKSHLRTHTGERPFACDWQGCDKKFARSDELARHHRTHTGEKRFSCPLCSKRFTRSDHLAKHARRHPGFHPDLLRRPGARSTSPSDSLPCSLAGSPAPSPAPSPAPAGL

SEQ ID NO: 15215 - protein, 389 aa, Homo Sapiens
MYGRPQAEMEQEAGELSRWQAAHQAAQDNENSAPILNMSSSSGSSGVHTSWNQGLPSIQHFPHSAEMLGSPLVSVEAPGQNVNEGGPQFSMPLPERGMSYCPQATLTPSRMIYCQRMSPPQQEMTIFSGPQLMPVGEPNIPRVARPFGGNLRMPPNGLPVSASTGIPIMSHTGNPPVPYPGLSTVPSDETLLGPTVPSTEAQAVLPSMAQMLPPQDAHDLGMPPAESQSLLVLGSQDSLVSQPDSQEGPFLPEQPGPAPQTVEKNSRPQEGTGRRGSSEARPYCCNYENCGKAYTKRSHLVSHQRKHTGERPYSCNWESCSWSFFRSDELRRHMRVHTRYRPYKCDQCSREFMRSDHLKQHQKTHRPGPSDPQANNNNGEQDSPPAAGP

SEQ ID NO: 15216 - protein, 355 aa, Homo Sapiens
MALSEPILPSFSTFASPCRERGLQERWPRAEPESGGTDDDLNSVLDFILSMGLDGLGAEAAPEPPPPPPPPAFYYPEPGAPPPYSAPAGGLVSELLRPELDAPLGPALHGRFLLAPPGRLVKAEPPEADGGGGYGCAPGLTRGPRGLKREGAPGPAASCMRGPGGRPPPPPDTPPLSPDGPARLPAPGPRASFPPPFGGPGFGAPGPGLHYAPPAPPAFGLFDDAAAAAAALGLAPPAARGLLTPPASPLELLEAKPKRGRRSWPRKRTATHTCSYAGCGKTYTKSSHLKAHLRTHTGEKPYHCNWDGCGWKFARSDELTRHYRKHTGHRPFQCHLCDRAFSRSDHLALHMKRHM

SEQ ID NO: 15217 - protein, 345 aa, Homo Sapiens
MLMFDPVPVKQEAMDPVSVSYPSNYMESMKPNKYGVIYSTPLPEKFFQTPEGLSHGIQMEPVDLTVNKRSSPPSAGNSPSSLKFPSSHRRASPGLSMPSSSPPIKKYSPPSPGVQPFGVPLSMPPVMAAALSRHGIRSPGILPVIQPVVVQPVPFMYTSHLQQPLMVSLSEEMENSSSSMQVPVIESYEKPISQKKIKIEPGIEPQRTDYYPEEMSPPLMNSVSPPQALLQENHPSVIVQPGKRPLPVESPDTQRKRRIHRCDYDGCNKVYTKSSHLKAHRRTHTGEKPYKCTWEGCTWKFARSDELTRHFRKHTGIKPFQCPDCDRSFSRSDHLALHRKRHMLV

SEQ ID NO: 15218 - protein, 513 aa, Homo Sapiens
MRQPPGESDMAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQGQSRGFVARAGEPCVCWPHFGTHGMMLTPPSSPLELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 15219 - protein, 457 aa, Homo Sapiens
MATRVLSMSARLGPVPQPPAPQDEPVFAQLKPVLGAANPARDAALFPGEELKHAHHRPQAQPAPAQAPQPAQPPATGPRLPPEDLVQTRCEMEKYLTPQLPPVPIIPEHKKYRRDSASVVDQFFTDTEGLPYSINMNVFLPDITHLRTGLYKSQRPCVTHIKTEPVAIFSHQSETTAPPPAPTQALPEFTSIFSSHQTAAPEVNNIFIKQELPTPDLHLSVPTQQGHLYQLLNTPDLDMPSSTNQTAAMDTLNVSMSAAMAGLNTHTSAVPQTAVKQFQGMPPCTYTMPSQFLPQQATYFPPSPPSSEPGSPDRQAEMLQNLTPPPSYAATIASKLAIHNPNLPTTLPVNSQNIQPVRYNRRSNPDLEKRRIHYCDYPGCTKVYTKSSHLKAHLRTHTGEKPYKCTWEGCDWRFARSDELTRHYRKHTGAKPFQCGVCNRSFSRSDHLALHMKRHQN

SEQ ID NO: 15220 - protein, 283 aa, Homo Sapiens
MDVLPMCSIFQELQIVHETGYFSALPSLEEYWQQTCLELERYLQSEPCYVSASEIKFDSQEDLWTKIILAREKKEESELKISSSPPEDTLISPSFCYNLETNSLNSDVSSESSDSSEELSPTAKFTSDPIGEVLVSSGKLSSSVTSTPPSSPELSREPSQLWGCVPGELPSPGKVRSGTSGKPGDKGNGDASPDGRRRVHRCHFNGCRKVYTKSSHLKAHQRTHTGEKPYRCSWEGCEWRFARSDELTRHFRKHTGAKPFKCSHCDRCFSRSDHLALHMKRHL

SEQ ID NO: 15221 - protein, 302 aa, Homo Sapiens
MDVLASYSIFQELQLVHDTGYFSALPSLEETWQQTCLELERYLQTEPRRISETFGEDLDCFLHASPPPCIEESFRRLDPLLLPVEAAICEKSSAVDILLSRDKLLSETCLSLQPASSSLDSYTAVNQAQLNAVTSLTPPSSPELSRHLVKTSQTLSAVDGTVTLKLVAKKAALSSVKVGGVATAAAAVTAAGAVKSGQSDSDQGGLGAEACPENKKRVHRCQFNGCRKVYTKSSHLKAHQRTHTGEKPYKCSWEGCEWRFARSDELTRHYRKHTGAKPFKCNHCDRCFSRSDHLALHMKRHI

SEQ ID NO: 15222 - protein, 359 aa, Homo Sapiens
MVDMDKLINNLEVQLNSEGGSMQVFKQVTASVRNRDPPEIEYRSNMTSPTLLDANPMENPALFNDIKIEPPEELLASDFSLPQVEPVDLSFHKPKAPLQPASMLQAPIRPPKPQSSPQTLVVSTSTSDMSTSANIPTVLTPGSVLTSSQSTGSQQILHVIHTIPSVSLPNKMGGLKTIPVVVQSLPMVYTTLPADGGPAAITVPLIGGDGKNAGSVKVDPTSMSPLEIPSDSEESTIESGSSALQSLQGLQQEPAAMAQMQGEESLDLKRRRIHQCDFAGCSKVYTKSSHLKAHRRIHTGEKPYKCTWDGCSWKFARSDELTRHFRKHTGIKPFRCTDCNRSFSRSDHLSLHRRRHDTM

SEQ ID NO: 15223 - protein, 244 aa, Homo Sapiens
MSAAAYMDFVAAQCLVSISNRAAVPEHGVAPDAERLRLPEREVTKEHGDPGDTWKDYCTLVTIAKSLLDLNKYRPIQTPSVCSDSLESPDEDMGSDSDVTTESGSSPSHSPEERQDPGSAPSPLSLLHPGVAAKGKHASEKRHKCPYSGCGKVYGKSSHLKAHYRVHTGERPFPCTWPDCLKKFSRSDELTRHYRTHTGEKQFRCPLCEKRFMRSDHLTKHARRHTEFHPSMIKRSKKALANAL

SEQ ID NO: 15224 - protein, 3969 aa, Homo Sapiens
MAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 15225 - protein, 2715 aa, Homo Sapiens
MAAAAGGGSCPGPGSARGRFPGRPRGAGGGGGRGGRGNGAERVRVALRRGGGATGPGGAEPGEDTALLRLLGLRRGLRRLRRLWAGPRVQRGRGRGRGRGWGPSRGCVPEEESSDGESDEEEFQGFHSDEDVAPSSLRSALRSQRGRAPRGRGRKHKTTPLPPPRLADVAPTPPKTPARKRGEEGTERMVQALTELLRRAQAPQAPRSRACEPSTPRRSRGRPPGRPAGPCRRKQQAVVVAEAAVTIPKPEPPPPVVPVKHQTGSWKCKEGPGPGPGTPRRGGQSSRGGRGGRGRGRGGGLPFVIKFVSRAKKVKMGQLSLGLESGQGQGQHEESWQDVPQRRVGSGQGGSPCWKKQEQKLDDEEEEKKEEEEKDKEGEEKEERAVAEEMMPAAEKEEAKLPPPPLTPPAPSPPPPLPPPSTSPPPPLCPPPPPPVSPPPLPSPPPPPAQEEQEESPPPVVPATCSRKRGRPPLTPSQRAEREAARAGPEGTSPPTPTPSTATGGPPEDSPTVAPKSTTFLKNIRQFIMPVVSARSSRVIKTPRRFMDEDPPKPPKVEVSPVLRPPITTSPPVPQEPAPVPSPPRAPTPPSTPVPLPEKRRSILREPTFRWTSLTRELPPPPPAPPPPPAPSPPPAPATSSRRPLLLRAPQFTPSEAHLKIYESVLTPPPLGAPEAPEPEPPPADDSPAEPEPRAVGRTNHLSLPRFAPVVTTPVKAEVSPHGAPALSNGPQTQAQLLQPLQALQTQLLPQALPPPQPQLQPPPSPQQMPPLEKARIAGVGSLPLSGVEEKMFSLLKRAKVQLFKIDQQQQQKVAASMPLSPGGQMEEVAGAVKQISDRGPVRSEDESVEAKRERPSGPESPVQGPRIKHVCRHAAVALGQARAMVPEDVPRLSALPLRDRQDLATEDTSSASETESVPSRSRRGKVEAAGPGGESEPTGSGGTLAHTPRRSLPSHHGKKMRMARCGHCRGCLRVQDCGSCVNCLDKPKFGGPNTKKQCCVYRKCDKIEARKMERLAKKGRTIVKTLLPWDSDESPEASPGPPGPRRGAGAGGPREEVVAHPGPEEQDSLLQRKSARRCVKQRPSYDIFEDSDDSEPGGPPAPRRRTPRENELPLPEPEEQSRPRKPTLQPVLQLKARRRLDKDALAPGPFASFPNGWTGKQKSPDGVHRVRVDFKEDCDLENVWLMGGLSVLTSVPGGPPMVCLLCASKGLHELVFCQVCCDPFHPFCLEEAERPLPQHHDTWCCRRCKFCHVCGRKGRGSKHLLECERCRHAYHPACLGPSYPTRATRKRRHWICSACVRCKSCGATPGKNWDVEWSGDYSLCPRCTQLYEKGNYCPICTRCYEDNDYESKMMQCAQCDHWVHAKCEGLSDEDYEILSGLPDSVLYTCGPCAGAAQPRWREALSGALQGGLRQVLQGLLSSKVVGPLLLCTQCGPDGKQLHPGPCGLQAVSQRFEDGHYKSVHSFMEDMVGILMRHSEEGETPDRRAGGQMKGLLLKLLESAFGWFDAHDPKYWRRSTRLPNGVLPNAVLPPSLDHVYAQWRQQEPETPESGQPPGDPSAAFQGKDPAAFSHLEDPRQCALCLKYGDADSKEAGRLLYIGQNEWTHVNCAIWSAEVFEENDGSLKNVHAAVARGRQMRCELCLKPGATVGCCLSSCLSNFHFMCARASYCIFQDDKKVFCQKHTDLLDGKEIVNPDGFDVLRRVYVDFEGINFKRKFLTGLEPDAINVLIGSIRIDSLGTLSDLSDCEGRLFPIGYQCSRLYWSTVDARRRCWYRCRILEYRPWGPREEPAHLEAAEENQTIVHSPAPSSEPPGGEDPPLDTDVLVPGAPERHSPIQNLDPPLRPDSGSAPPPAPRSFSGARIKVPNYSPSRRPLGGVSFGPLPSPGSPSSLTHHIPTVGDPDFPAPPRRSRRPSPLAPRPPPSRWASPPLKTSPQLRVPPPTSVVTALTPTSGELAPPGPAPSPPPPEDLGPDFEDMEVVSGLSAADLDFAASLLGTEPFQEEIVAAGAMGSSHGGPGDSSEEESSPTSRYIHFPVTVVSAPGLAPSATPGAPRIEQLDGVDDGTDSEAEAVQQPRGQGTPPSGPGVVRAGVLGAAGDRARPPEDLPSEIVDFVLKNLGGPGDGGAGPREESLPPAPPLANGSQPSQGLTASPADPTRTFAWLPGAPGVRVLSLGPAPEPPKPATSKIILVNKLGQVFVKMAGEGEPVPPPVKQPPLPPTISPTAPTSWTLPPGPLLGVLPVVGVVRPAPPPPPPPLTLVLSSGPASPPRQAIRVKRVSTFSGRSPPAPPPYKAPRLDEDGEASEDTPQVPGLGSGGFSRVRMKTPTVRGVLDLDRPGEPAGEESPGPLQERSPLLPLPEDGPPQVPDGPPDLLLESQWHHYSGEASSSEEEPPSPDDKENQAPKRTGPHLRFEISSEDGFSVEAESLEGAWRTLIEKVQEARGHARLRHLSFSGMSGARLLGIHHDAVIFLAEQLPGAQRCQHYKFRYHQQGEGQEEPPLNPHGAARAEVYLRKCTFDMFNFLASQHRVLPEGATCDEEEDEVQLRSTRRATSLELPMAMRFRHLKKTSKEAVGVYRSAIHGRGLFCKRNIDAGEMVIEYSGIVIRSVLTDKREKFYDGKGIGCYMFRMDDFDVVDATMHGNAARFINHSCEPNCFSRVIHVEGQKHIVIFALRRILRGEELTYDYKFPIEDASNKLPCNCGAKRCRRFLN

SEQ ID NO: 15226 - protein, 4911 aa, Homo Sapiens
MSSEEDKSVEQPQPPPPPPEEPGAPAPSPAAADKRPRGRPRKDGASPFQRARKKPRSRGKTAVEDEDSMDGLETTETETIVETEIKEQSAEEDAEAEVDNSKQLIPTLQRSVSEESANSLVSVGVEAKISEQLCAFCYCGEKSSLGQGDLKQFRITPGFILPWRNQPSNKKDIDDNSNGTYEKMQNSAPRKQRGQRKERSPQQNIVSCVSVSTQTASDDQAGKLWDELSLVGLPDAIDIQALFDSTGTCWAHHRCVEWSLGVCQMEEPLLVNVDKAVVSGSTERCAFCKHLGATIKCCEEKCTQMYHYPCAAGAGTFQDFSHIFLLCPEHIDQAPERSKEDANCAVCDSPGDLLDQFFCTTCGQHYHGMCLDIAVTPLKRAGWQCPECKVCQNCKQSGEDSKMLVCDTCDKGYHTFCLQPVMKSVPTNGWKCKNCRICIECGTRSSSQWHHNCLICDNCYQQQDNLCPFCGKCYHPELQKDMLHCNMCKRWVHLECDKPTDHELDTQLKEEYICMYCKHLGAEMDRLQPGEEVEIAELTTDYNNEMEVEGPEDQMVFSEQAANKDVNGQESTPGIVPDAVQVHTEEQQKSHPSESLDTDSLLIAVSSQHTVNTELEKQISNEVDSEDLKMSSEVKHICGEDQIEDKMEVTENIEVVTHQITVQQEQLQLLEEPETVVSREESRPPKLVMESVTLPLETLVSPHEESISLCPEEQLVIERLQGEKEQKENSELSTGLMDSEMTPTIEGCVKDVSYQGGKSIKLSSETESSFSSSADISKADVSSSPTPSSDLPSHDMLHNYPSALSSSAGNIMPTTYISVTPKIGMGKPAITKRKFSPGRPRSKQGAWSTHNTVSPPSWSPDISEGREIFKPRQLPGSAIWSIKVGRGSGFPGKRRPRGAGLSGRGGRGRSKLKSGIGAVVLPGVSTADISSNKDDEENSMHNTVVLFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQNNYTQCAPCASLSSCPVCYRNYREEDLILQCRQCDRWMHAVCQNLNTEEEVENVADIGFDCSMCRPYMPASNVPSSDCCESSLVAQIVTKVKELDPPKTYTQDGVCLTESGMTQLQSLTVTVPRRKRSKPKLKLKIINQNSVAVLQTPPDIQSEHSRDGEMDDSREGELMDCDGKSESSPEREAVDDETKGVEGTDGVKKRKRKPYRPGIGGFMVRQRSRTGQGKTKRSVIRKDSSGSISEQLPCRDDGWSEQLPDTLVDESVSVTESTEKIKKRYRKRKNKLEETFPAYLQEAFFGKDLLDTSRQSKISLDNLSEDGAQLLYKTNMNTGFLDPSLDPLLSSSSAPTKSGTHGPADDPLADISEVLNTDDDILGIISDDLAKSVDHSDIGPVTDDPSSLPQPNVNQSSRPLSEEQLDGILSPELDKMVTDGAILGKLYKIPELGGKDVEDLFTAVLSPANTQPTPLPQPPPPTQLLPIHNQDAFSRMPLMNGLIGSSPHLPHNSLPPGSGLGTFSAIAQSSYPDARDKNSAFNPMASDPNNSWTSSAPTVEGENDTMSNAQRSTLKWEKEEALGEMATVAPVLYTNINFPNLKEEFPDWTTRVKQIAKLWRKASSQERAPYVQKARDNRAALRINKVQMSNDSMKRQQQQDSIDPSSRIDSELFKDPLKQRESEHEQEWKFRQQMRQKSKQQAKIEATQKLEQVKNEQQQQQQQQFGSQHLLVQSGSDTPSSGIQSPLTPQPGNGNMSPAQSFHKELFTKQPPSTPTSTSSDDVFVKPQAPPPPPAPSRIPIQDSLSQAQTSQPPSPQVFSPGSSNSRPPSPMDPYAKMVGTPRPPPVGHSFSRRNSAAPVENCTPLSSVSRPLQMNETTANRPSPVRDLCSSSTTNNDPYAKPPDTPRPVMTDQFPKSLGLSRSPVVSEQTAKGPIAAGTSDHFTKPSPRADVFQRQRIPDSYARPLLTPAPLDSGPGPFKTPMQPPPSSQDPYGSVSQASRRLSVDPYERPALTPRPIDNFSHNQSNDPYSQPPLTPHPAVNESFAHPSRAFSQPGTISRPTSQDPYSQPPGTPRPVVDSYSQSSGTARSNTDPYSQPPGTPRPTTVDPYSQQPQTPRPSTQTDLFVTPVTNQRHSDPYAHPPGTPRPGISVPYSQPPATPRPRISEGFTRSSMTRPVLMPNQDPFLQAAQNRGPALPGPLVRPPDTCSQTPRPPGPGLSDTFSRVSPSAARDPYDQSPMTPRSQSDSFGTSQTAHDVADQPRPGSEGSFCASSNSPMHSQGQQFSGVSQLPGPVPTSGVTDTQNTVNMAQADTEKLRQRQKLREIILQQQQQKKIAGRQEKGSQDSPAVPHPGPLQHWQPENVNQAFTRPPPPYPGNIRSPVAPPLGPRYAVFPKDQRGPYPPDVASMGMRPHGFRFGFPGGSHGTMPSQERFLVPPQQIQGSGVSPQLRRSVSVDMPRPLNNSQMNNPVGLPQHFSPQSLPVQQHNILGQAYIELRHRAPDGRQRLPFSAPPGSVVEASSNLRHGNFIPRPDFPGPRHTDPMRRPPQGLPNQLPVHPDLEQVPPSQQEQGHSVHSSSMVMRTLNHPLGGEFSEAPLSTSVPSETTSDNLQITTQPSDGLEEKLDSDDPSVKELDVKDLEGVEVKDLDDEDLENLNLDTEDGKVVELDTLDNLETNDPNLDDLLRSGEFDIIAYTDPELDMGDKKSMFNEELDLPIDDKLDNQCVSVEPKKKEQENKTLVLSDKHSPQKKSTVTNEVKTEVLSPNSKVESKCETEKNDENKDNVDTPCSQASAHSDLNDGEKTSLHPCDPDLFEKRTNRETAGPSANVIQASTQLPAQDVINSCGITGSTPVLSSLLANEKSDNSDIRPSGSPPPPTLPASPSNHVSSLPPFIAPPGRVLDNAMNSNVTVVSRVNHVFSQGVQVNPGLIPGQSTVNHSLGTGKPATQTGPQTSQSGTSSMSGPQQLMIPQTLAQQNRERPLLLEEQPLLLQDLLDQERQEQQQQRQMQAMIRQRSEPFFPNIDFDAITDPIMKAKMVALKGINKVMAQNNLGMPPMVMSRFPFMGQVVTGTQNSEGQNLGPQAIPQDGSITHQISRPNPPNFGPGFVNDSQRKQYEEWLQETQQLLQMQQKYLEEQIGAHRKSKKALSAKQRTAKKAGREFPEEDAEQLKHVTEQQSMVQKQLEQIRKQQKEHAELIEDYRIKQQQQCAMAPPTMMPSVQPQPPLIPGATPPTMSQPTFPMVPQQLQHQQHTTVISGHTSPVRMPSLPGWQPNSAPAHLPLNPPRIQPPIAQLPIKTCTPAPGTVSNANPQSGPPPRVEFDDNNPFSESFQERERKERLREQQERQRIQLMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLQTLGAQMQGGFGCGNQLPKTDGGSETKKQRSKRTQRTGEKAAPRSKKRKKDEEEKQAMYSSTDTFTHLKQQNNLSNPPTPPASLPPTPPPMACQKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIPNSYEVSSAPDVPSMGLVSSHRINPGLEYRQHLLLRGPPPGSANPPRLVSSYRLKQPNVPFPPTSNGLSGYKDSSHGIAESAALRPQWCCHCKVVILGSGVRKSFKDLTLLNKDSRESTKRVEKDIVFCSNNCFILYSSTAQAKNSENKESIPSLPQSPMRETPSKAFHQYSNNISTLDVHCLPQLPEKASPPASPPIAFPPAFEAAQVEAKPDELKVTVKLKPRLRAVHGGFEDCRPLNKKWRGMKWKKWSIHIVIPKGTFKPPCEDEIDEFLKKLGTSLKPDPVPKDYRKCCFCHEEGDGLTDGPARLLNLDLDLWVHLNCALWSTEVYETQAGALINVELALRRGLQMKCVFCHKTGATSGCHRFRCTNIYHFTCAIKAQCMFFKDKTMLCPMHKPKGIHEQELSYFAVFRRVYVQRDEVRQIASIVQRGERDHTFRVGSLIFHTIGQLLPQQMQAFHSPKALFPVGYEASRLYWSTRYANRRCRYLCSIEEKDGRPVFVIRIVEQGHEDLVLSDISPKGVWDKILEPVACVRKKSEMLQLFPAYLKGEDLFGLTVSAVARIAESLPGVEACENYTFRYGRNPLMELPLAVNPTGCARSEPKMSAHVKRFVLRPHTLNSTSTSKSFQSTVTGELNAPYSKQFVHSKSSQYRKMKTEWKSNVYLARSRIQGLGLYAARDIEKHTMVIEYIGTIIRNEVANRKEKLYESQNRGVYMFRMDNDHVIDATLTGGPARYINHSCAPNCVAEVVTFERGHKIIISSSRRIQKGEELCYDYKFDFEDDQHKIPCHCGAVNCRKWMN

SEQ ID NO: 15227 - protein, 1858 aa, Homo Sapiens
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNGENKSPLLLNDSCSLPDLTTPLKKRRFYQLLDSVYSETSTPTPSPYATPTHTDITPMDPSFATPPRIKSDDETCRNGYKPIYSPVTPVTPGTPGNTMHFENISSPESSPEIKRRTYSQEGYDRSSTMLTLGPFRNSNLTELGLQEIKTIGYTSPRSRTEVNRQCPGEKEPVSDLQLGLDAVEPTALHKTLETPAHDRAEPNSQLDSTHSGRGTMYSSWVKSPDRTGVNFSVNSNLRDLTPSHQLEVGGGFRISESKCLMQDDTRGMFMETTVFCTSEDGLVSGFGRTVNDNLIDGNCTPQNPPQKKKVSLLEYRKRQREARKSGSKTENFPLISVSPHASGSLSNNGDGCASSNDNGEQVDHTASLPLPTPATVYNATSEETSNNCPVKDATASEKNEPEVQWTASTSVEQVRERSYQRALLLSDHRKDKDSGGESPCVSCSPSHVQSSPSSHSNHIPQLQAKGPVPSFSELMEDPDPENPEPTTTNECPSPDTSQNTCKSPPKMSKPGSPGSVIPAQAHGKIFTKPDPQWDSTVSASEAENGVHLKTELQQKQLSNNNQALSKNHPPQTHVRNSSEQLSQKLPSVPTKLHCPPSPHLENPPKSSTPHTPVQHGYLSPKPPSQQLGSPYRPHHSQSPQVGTPQREPQRNFYPAAQNLPANTQQATSGTLFTQTPSGQSSATYSQFNQQSLNSTAPPPPPPPPPSSSYYQNQQPSANFQNYNQLKGSLSQQTVFTSGPNQALPGTTSQQTVPGHHVTPGHFLPSQNPTIHHQTAAAVVPPPPPPPPAPGPHLVQQPNSHQQHSVAHVVGPVHAVTPGSHIHSQTAGHHLPPPPPPPGPAPHHHPPPHPSTGLQGLQAQHQHVVNSAPPPPPPPPPSSVLASGHHTTSAQALHHPPHQGPPLFPSSAHPTVPPYPSQATHHTTLGPGPQHQPSGTGPHCPLPVTGPHLQPQGPNSIPTPTASGFCPHPGSVALPHGVQGPQQASPVPGQIPIHRAQVPPTFQNNYHGSGWH

SEQ ID NO: 15228 - protein, 840 aa, Homo Sapiens
MHLVAGDSPGSGPHLPATAFIIPASSATLGLPSSALDVSCFPREPIHVGAPEQVAGCEPVSATVLPQLSAGPASSSTSTVRLLEWTEAAAPPPGGGLRFRISEYKPLNMAGVEQPPSPELRQEGVTEYEDGGAPAGDGEAGPQQAEDHPQNPPEDPNQDPPEDDSTCQCQACGPHQAAGPDLGSSNDGCPQLFQERSVIVENSSGSTSASELLKPMKKRKRREYQSPSEEESEPEAMEKQEEGKDPEGQPTASTPESEEWSSSQPATGEKKECWSWESYLEEQKAITAPVSLFQDSQAVTHNKNGFKLGMKLEGIDPQHPSMYFILTVAEVCGYRLRLHFDGYSECHDFWVNANSPDIHPAGWFEKTGHKLQPPKGYKEEEFSWSQYLRSTRAQAAPKHLFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEARIVRVTHVSGKTLVWTVAQLGDLVCSDHLQEGKGILETGVHSLLCSLPTHLLAKLSFASDSQY

SEQ ID NO: 15229 - protein, 705 aa, Homo Sapiens; identical to SEQ ID NO: 7623

SEQ ID NO: 15230 - protein, 780 aa, Homo Sapiens
MTESASSTSGQEFDVFSVMDWKDGVGTLPGSDLKFRVNEFGALEVITDENEMENVKKATATTTWMVPTAQEAPTSPPSSRPVFPPAYWTSPPGCPTVFSEKTGMPFRLKDPVKVEGLQFCENCCQYGNVDECLSGGNYCSQNCARHIKDKDQKEERDVEEDNEEEDPKCSRKKKPKLSLKADTKEDGEERDDEMENKQDVRILRGSQRARRKRRGDSAVLKQGLPPKGKKAWCWASYLEEEKAVAVPAKLFKEHQSFPYNKNGFKVGMKLEGVDPEHQSVYCVLTVAEVCGYRIKLHFDGYSDCYDFWVNADALDIHPVGWCEKTGHKLHPPKGYKEEEFNWQTYLKTCKAQAAPKSLFENQNITVIPSGFRVGMKLEAVDKKNPSFICVATVTDMVDNRFLVHFDNWDESYDYWCEASSPHIHPVGWCKEHRRTLITPPGYPNVKHFSWDKYLEETNSLPAPARAFKVKPPHGFQKKMKLEVVDKRNPMFIRVATVADTDDHRVKVHFDGWNNCYDYWIDADSPDIHPVGWCSKTGHPLQPPLSPLELMEASEHGGCSTPGCKGIGHFKRARHLGPHSAANCPYSEINLNKDRIFPDRLSGEMPPASPSFPRNKRTDANESSSSPEIRDQHADDVKEDFEERTESEMRTSHEARGAREEPTVQQAQRRSAVFLSFKSPIPCLPLRWEQQSKLLPTVAGIPASKVSKWSTDEVSEFIQSLPGCEEHGKVFKDEQIDGEAFLLMTQTDIVKIMSIKLGPALKIFNSILMFKAAEKNSHNEL

SEQ ID NO: 15231 - protein, 623 aa, Homo Sapiens
MKQPNRKRKLNMDSKERLDQDGRLEQAEEEKKPKDSTTPLSHVPSAAAQGAWSWEWYLKEQKAVAAPVELFSKDQSFPEHENGFQIGMRLEGIDPRHPSVFCVLSVAEVCGYRLRLHFDGYLSCYDFWTNAGSPDIHPVGWCEKTKHELHIPKGYRKDKFVWMDYLKACKLQNAPKKLFRNRSPNGPMSKEFQVGMKLEAVDRKNPSLVCVATIADIVEDRLLVHFDNWDDSYDYWCDVNSPYVQPVGWCQENGRTLIAPQGYPNPENFSWTEYLEATQTNAVPAKVFKMRLPHGFLPNMKLEVVDKRNPRLIRVATIVDVDDQRVKVHFDGWDHKYDYWVEADSPDIHPIGWCDVTGHPLEVPQRTNDLKILPGQAVCPTPGCRGIGHIRGPRYSGHHSAFGCPYSDMNLKKEATLHDRLREQTQANLESDSSHSKSKSLCSLNFNGKHEKVNSQPRLVQQAKCLKIKGKEDIDLDNLFRVLVLHPRGLEYSVEQAQQVLHQSVSMSTVSAHPFRDLPLGREQHCKLLPGVADIRASQVARWTVDEVAEFVQSLLGCEEHAKCFKKEQIDGKAFLLLTQTDIVKVMKIKLGPALKIYNSILMFRHSQELPEEDIASGQEVRG

SEQ ID NO: 15232 - protein, 281 aa, Homo Sapiens
MTSKEDGKAAPGEERRRSPLDHLPPPANSNKPLTPFSIEDILNKPSVRRSYSLCGAAHLLAAADKHAQGGLPLAGRALLSQTSPLCALEELASKTFKGLEVSVLQAAEGRDGMTIFGQRQTPKKRRKSRTAFTNHQIYELEKRFLYQKYLSPADRDQIAQQLGLTNAQVITWFQNRRAKLKRDLEEMKADVESAKKLGPSGQMDIVALAELEQNSEATAGGGGGCGRAKSRPGSPVLPPGAPKAPGAGALQLSPASPLTDQPASSQDCSEDEEDEEIDVDD

SEQ ID NO: 15233 - protein, 198 aa, Homo Sapiens
MNSGREPRTPRTLLSIADILAPRMVPRAPSAPQLPESGPGPTSPLCALEELTSKTFRGLDARALQPSEGRAGPDALGPGPFGRKRRKSRTAFTAQQVLELERRFVFQKYLAPSERDGLATRLGLANAQVVTWFQNRRAKLKRDVEEMRADVASLRALSPEVLCSLALPEGAPDPGLCLGPAGPDSRPHLSDEEIQVDD

SEQ ID NO: 15234 - protein, 433 aa, Homo Sapiens
MQRMIQQFAAEYTSKNSSTQDPSQPNSTKNQSLPKASPVTTSPTAATTQNPVLSKLLMADQDSPLDLTVRKSQSEPSEQDGVLDLSTKKSPCAGSTSLSHSPGCSSTQGNGRPGRPSQYRPDGLRSGDGVPPRSLQDGTREGFGHSTSLKVPLARSLQISEELLSRNQLSTAASLGPSGLQNHGQHLILSREASWAKPHYEFNLSRMKFRGNGALSNISDLPFLAENSAFPKMALQAKQDGKKDVSHSSPVDLKIPQVRGMDLSWESRTGDQYSYSSLVMGSQTESALSKKLRAILPKQSRKSMLDAGPDSWGSDAEQSTSGQPYPTSDQEGDPGSKQPRKKRGRYRQYNSEILEEAISVVMSGKMSVSKAQSIYGIPHSTLEYKVKERLGTLKNPPKKKMKLMRSEGPDVSVKIELDPQGEAAQSANESKNE

SEQ ID NO: 15235 - protein, 602 aa, Homo Sapiens; identical to SEQ ID NO: 7758

SEQ ID NO: 15236 - protein, 399 aa, Homo Sapiens
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWQGQPVYPITGGFRQPYPSSLSVDTSMSRFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGTGPRMTAAYI

SEQ ID NO: 15237 - protein, 168 aa, Homo Sapiens
MHPSLATMGKLASKLQLDLSVVKIWFKNQRAKWKRQQRQQMQTRPSLGPANQTTSVKKEETPSAITTANIRPVSPGISDANDHDLREPSGIKNPGGASASARVSSWDSQSYDIEQICLGASNPPWASTLFEIDEFVKIYDLPGEDDTSSLNQYLFPVCLEYDQLQSSV

SEQ ID NO: 15238 - protein, 406 aa, Homo Sapiens
MVHCAGCKRPILDRFLLNVLDRAWHVKCVQCCECKCNLTEKCFSREGKLYCKNDFFRCFGTKCAGCAQGISPSDLVRRARSKVFHLNCFTCMMCNKQLSTGEELYIIDENKFVCKEDYLSNSSVAKENSLHSATTGSDPSLSPDSQDPSQDDAKDSESANVSDKEAGSNENDDQNLGAKRRGPRTTIKAKQLETLKAAFAATPKPTRHIREQLAQETGLNMRVIQVWFQNRRSKERRMKQLSALGARRHAFFRSPRRMRPLVDRLEPGELIPNGPFSFYGDYQSEYYGPGGNYDFFPQGPPSSQAQTPVDLPFVPSSGPSGTPLGGLEHPLPGHHPSSEAQRFTDILAHPPGDSPSPEPSLPGPLHSMSAEVFGPSPPFSSLSVNGGASYGNHLSHPPEMNEAAVW

SEQ ID NO: 15239 - protein, 406 aa, Homo Sapiens
MLFHSLSGPEVHGVIDEMDRRAKSEAPAISSAIDRGDTETTMPSISSDRAALCAGCGGKISDRYYLLAVDKQWHMRCLKCCECKLNLESELTCFSKDGSIYCKEDYYRRFSVQRCARCHLGISASEMVMRARDLVYHLNCFTCTTCNKMLTTGDHFGMKDSLVYCRLHFEALLQGEYPAHFNHADVAAAAAAAAAAKSAGLGAAGANPLGLPYYNGVGTVQKGRPRKRKSPGPGADLAAYNAALSCNENDAEHLDRDQPYPSSQKTKRMRTSFKHHQLRTMKSYFAINHNPDAKDLKQLAQKTGLTKRVLQVWFQNARAKFRRNLLRQENTGVDKSTDAALQTGTPSGPASELSNASLSPSSTPTTLTDLTSPTLPTVTSVLTSVPGNLEGHEPHSPSQTTLTNLF

SEQ ID NO: 15240 - protein, 397 aa, Homo Sapiens
MLLETGLERDRARPGAAAVCTLGGTREIPLCAGCDQHILDRFILKALDRHWHSKCLKCSDCHTPLAERCFSRGESVYCKDDFFKRFGTKCAACQLGIPPTQVVRRAQDFVYHLHCFACVVCKRQLATGDEFYLMEDSRLVCKADYETAKQREAEATAKRPRTTITAKQLETLKSAYNTSPKPARHVREQLSSETGLDMRVVQVWFQNRRAKEKRLKKDAGRQRWGQYFRNMKRSRGGSKSDKDSVQEGQDSDAEVSFPDEPSLAEMGPANGLYGSLGEPTQALGRPSGALGNFSLEHGGLAGPEQYRELRPGSPYGVPPSPAAPQSLPGPQPLLSSLVYPDTSLGLVPSGAPGGPPPMRVLAGNGPSSDLSTGSSGGYPDFPASPASWLDEVDHAQF

SEQ ID NO: 15241 - protein, 390 aa, Homo Sapiens
MMQSATVPAEGAVKGLPEMLGVPMQQIPQCAGCNQHILDKFILKVLDRHWHSSCLKCADCQMQLADRCFSRAGSVYCKEDFFKRFGTKCTACQQGIPPTQVVRKAQDFVYHLHCFACIICNRQLATGDEFYLMEDGRLVCKEDYETAKQNDDSEAGAKRPRTTITAKQLETLKNAYKNSPKPARHVREQLSSETGLDMRVVQVWFQNRRAKEKRLKKDAGRHRWGQFYKSVKRSRGSSKQEKESSAEDCGVSDSELSFREDQILSELGHTNRIYGNVGDVTGGQLMNGSFSMDGTGQSYQDLRDGSPYGIPQSPSSISSLPSHAPLLNGLDYTVDSNLGIIAHAGQGVSQTLRAMAGGPTSDISTGSSVGYPDFPTSPGSWLDEMDHPPF

SEQ ID NO: 15242 - protein, 402 aa, Homo Sapiens
MMVHCAGCERPILDRFLLNVLDRAWHIKCVQCCECKTNLSEKCFSREGKLYCKNDFFRRFGTKCAGCAQGISPSDLVRKARSKVFHLNCFTCMVCNKQLSTGEELYVIDENKFVCKDDYLSSSSLKEGSLNSVSSCTDRSLSPDLQDALQDDPKETDNSTSSDKETANNENEEQNSGTKRRGPRTTIKAKQLETLKAAFAATPKPTRHIREQLAQETGLNMRVIQVWFQNRRSKERRMKQLSALGARRHAFFRSPRRMRPLGGRLDESEMLGSTPYTYYGDYQGDYYAPGSNYDFFAHGPPSQAQSPADSSFLAASGPGSTPLGALEPPLAGPHAADNPRFTDMISHPDTPSPEPGLPGTLHPMPGEVFSGGPSPPFPMSGTSGYSGPLSHPNPELNEAAVW

SEQ ID NO: 15243 - protein, 363 aa, Homo Sapiens
MAQPGSGCKATTRCLEGTAPPAMAQSDAEALAGALDKDEGQASPCTPSTPSVCSPPSAASSVPSAGKNICSSCGLEILDRYLLKVNNLIWHVRCLECSVCRTSLRQQNSCYIKNKEIFCKMDYFSRFGTKCARCGRQIYASDWVRRARGNAYHLACFACFSCKRQLSTGEEFGLVEEKVLCRIHYDTMIENLKRAAENGNGLTLEGAVPSEQDSQPKPAKRARTSFTAEQLQVMQAQFAQDNNPDAQTLQKLADMTGLSRRVIQVWFQNCRARHKKHTPQHPVPPSGAPPSRLPSALSDDIHYTPFSSPERARMVTLHGYIESQVQCGQVHCRLPYTAPPVHLKADMDGPLSNRGEKVILFQY

SEQ ID NO: 15244 - protein, 356 aa, Homo Sapiens
MQILSRCQGLMSEECGRTTALAAGRTRKGAGEEGLVSPEGAGDEDSCSSSAPLSPSSSPRSMASGSGCPPGKCVCNSCGLEIVDKYLLKVNDLCWHVRCLSCSVCRTSLGRHTSCYIKDKDIFCKLDYFRRYGTRCSRCGRHIHSTDWVRRAKGNVYHLACFACFSCKRQLSTGEEFALVEEKVLCRVHYDCMLDNLKREVENGNGISVEGALLTEQDVNHPKPAKRARTSFTADQLQVMQAQFAQDNNPDAQTLQKLAERTGLSRRVIQVWFQNCRARHKKHVSPNHSSSTPVTAVPPSRLSPPMLEEMAYSAYVPQDGTMLTALHSYMDAHSPTTLGLQPLLPHSMTQLPISHT

SEQ ID NO: 15245 - protein, 397 aa, Homo Sapiens
MEIVGCRAEDNSCPFRPPAMLFHGISGGHIQGIMEEMERRSKTEARLAKGAQLNGRDAGMPPLSPEKPALCAGCGGKISDRYYLLAVDKQWHLRCLKCCECKLALESELTCFAKDGSIYCKEDYYRRFSVQRCARCHLGISASEMVMRARDSVYHLSCFTCSTCNKTLTTGDHFGMKDSLVYCRAHFETLLQGEYPPQLSYTELAAKSGGLALPYFNGTGTVQKGRPRKRKSPALGVDIVNYNSGCNENEADHLDRDQQPYPPSQKTKRMRTSFKHHQLRTMKSYFAINHNPDAKDLKQLAQKTGLTKRVLQVWFQNARAKFRRNLLRQENGGVDKADGTSLPAPPSADSGALTPPGTATTLTDLTNPTITVVTSVTSNMDSHESGSPSQTTLTNLF

SEQ ID NO: 15246 - protein, 382 aa, Homo Sapiens
MLDGLKMEENFQSAIDTSASFSSLLGRAVSPKSVCEGCQRVILDRFLLRLNDSFWHEQCVQCASCKEPLETTCFYRDKKLYCKYDYEKLFAVKCGGCFEAIAPNEFVMRAQKSVYHLSCFCCCVCERQLQKGDEFVLKEGQLLCKGDYEKERELLSLVSPAASDSGKSDDEESLCKSAHGAGKGTAEEGKDHKRPKRPRTILTTQQRRAFKASFEVSSKPCRKVRETLAAETGLSVRVVQVWFQNQRAKMKKLARRQQQQQQDQQNTQRLSSAQTNGGGSAGMEGIMNPYTALPTPQQLLAIEQSVYSSDPFRQGLTPPQMPGDHMHPYGAEPLFHDLDSDDTSLSNLGDCFLATSEAGPLQSRVGNPIDHLYSMQNSYFTS

SEQ ID NO: 15247 - protein, 402 aa, Homo Sapiens
MDIATGPESLERCFPRGQTDCAKMLDGIKMEEHALRPGPATLGVLLGSDCPHPAVCEGCQRPISDRFLMRVNESSWHEECLQCAACQQALTTSCYFRDRKLYCKQDYQQLFAAKCSGCMEKIAPTEFVMRALECVYHLGCFCCCVCERQLRKGDEFVLKEGQLLCKGDYEKEKDLLSSVSPDESDSVKSEDEDGDMKPAKGQGSQSKGSGDDGKDPRRPKRPRTILTTQQRRAFKASFEVSSKPCRKVRETLAAETGLSVRVVQVWFQNQRAKMKKLARRHQQQQEQQNSQRLGQEVLSSRMEGMMASYTPLAPPQQQIVAMEQSPYGSSDPFQQGLTPPQMPGDHMNPYGNDSIFHDIDSDTSLTSLSDCFLGSSDVGSLQARVGNPIDRLYSMQSSYFAS

SEQ ID NO: 15248 - protein, 808 aa, Homo Sapiens
MTSPAAAQSREIDCLSPEAQKLAEARLAAKRAARAEAREIRMKELERQQKEEDSERYSRRSRRNTSASDEDERMSVGSRGSLRVEERPEKDFTEKGSRNMPGLSAATLASLGGTSSRRGSGDTSISIDTEASIREIKELNELKDQIQDVEGKYMQGLKEMKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 15249 - protein, 721 aa, Homo Sapiens
MGTPASGRKRTPVKDRFSAEDEALSNIAREAEARLAAKRAARAEARDIRMRELERQQKEYSLHSFDRKWGQIQKWLEDSERARYSHRSSHHRPYLGVEDALSIRSVGSHRYDMFKDRSSRLSSLNHSYSHSHGMKKRSSDSHKDLLSGLYFDQRNYSSLRHSKPTSAYYTRQSSSLYSDPLATYKSDRASPTANSGLLRSASLASLYNGGLYNPYGPRTPSECSYYSSRISSARSSPGFTNDDTASIVSSDRASRGRRESVVSAADYFSRSNRRGSVVSEVDDISIPDLSSLDEKSDKQYAENYTRPSSRNSASATTPLSGNSSRRGSGDTSSLIDPDTSLSELRDIYDLKDQIQDVEGRYMQGLKELKESLSEVEEKYKKAMVSNAQLDNEKNNLIYQVDTLKDVIEEQEEQMAEFYRENEEKSKELERQKHMCSVLQHKMEELKEGLRQRDELIEEKQRMQQKIDTMTKEVFDLQETLLWKDKKIGALEKQKEYIACLRNERDMLREELADLQETVKTGEKHGLVIIPDGTPNGDVSHEPVAGAITVVSQEAAQVLESAGEGPLDVRLRKLAGEKEELLSQIRKLKLQLEEERQKCSRNDGTVGDLAGLQNGSDLQFIEMQRDANRQISEYKFKLSKAEQDITTLEQSISRLEGQVLRYKTAAENAEKVEDELKAEKRKLQRELRTALDKIEEMEMTNSHLAKRLEKMKANRTALLAQQ

SEQ ID NO: 15250 - protein, 379 aa, Homo Sapiens
MVFFTCNACGESVKKIQVEKHVSVCRNCECLSCIDCGKDFWGDDYKNHVKCISEDQKYGGKGYEGKTHKGDIKQQAWIQKISELIKRPNVSPKVRELLEQISAFDNVPRKKAKFQNWMKNSLKVHNESILDQVWNIFSEASNSEPVNKEQDQRPLHPVANPHAEISTKVPASKVKDAVEQQGEVKKNKRERKEERQKKRKREKKELKLENHQENSRNQKPKKRKKGQEADLEAGGEEVPEANGSAGKRSKKKKQRKDSASEEEAHVGAGKRKRRHSEVETDSKKKKMKLPEHPEGGEPEDDEAPAKGKFNWKGTIKAILKQAPDNEITIKKLRKKVLAQYYTVTDEHHRSEEELLVIFNKKISKNPTFKLLKDKVKLVK

SEQ ID NO: 15251 - protein, 280 aa, Homo Sapiens
MCPPQAQAEVGPTMTEKAEMVCAPSPAPAPPPKPASPGPPQVEEVGHRGGSSPPRLPPGVPVISLGHSRPPGVAMPTTELGTLRPPLLQLSTLGTAPPTLALHYHPHPFLNSVYIGPAGPFSIFPSSRLKRRPSHCELDLAEGHQPQKVARRVFTNSRERWRQQNVNGAFAELRKLLPTHPPDRKLSKNEVLRLAMKYIGFLVRLLRDQAAALAAGPTPPGPRKRPVHRVPDDGARRGSGRRAEAAARSQPAPPADPDGSPGGAARPIKMEQTALSPEVR

SEQ ID NO: 15252 - protein, 434 aa, Homo Sapiens
MPNRKASRNAYYFFVQEKIPELRRRGLPVARVADAIPYCSSDWALLREEEKEKYAEMAREWRAAQGKDPGPSEKQKPVFTPLRRPGMLVPKQNVSPPDMSALSLKGDQALLGGIFYFLNIFSHGELPPHCEQRFLPCEIGCVKYSLQEGIMADFHSFINPGEIPRGFRFHCQAASDSSHKIPISNFERGHNQATVLQNLYRFIHPNPGNWPPIYCKSDDRTRVNWCLKHMAKASEIRQDLQLLTVEDLVVGIYQQKFLKEPSKTWIRSLLDVAMWDYSSNTRCKWHEENDILFCALAVCKKIAYCISNSLATLFGIQLTEAHVPLQDYEASNSVTPKMVVLDAGRYQKLRVGSSGFSHFNSSNEEQRSNTPIGDYPSRAKISGQNSSVRGRGITRLLESISNSSSNIHKFSNCDTSLSPYMSQKDGYKSFSSLS

SEQ ID NO: 15253 - protein, 373 aa, Homo Sapiens
MASELAMSNSDLPTSPLAMEYVNDFDLMKFEVKKEPVETDRIISQCGRLIAGGSLSSTPMSTPCSSVPPSPSFSAPSPGSGSEQKAHLEDYYWMTGYPQQLNPEALGFSPEDAVEALISNSHQLQGGFDGYARGAQQLAAAAGAGAGASLGGSGEEMGPAAAVVSAVIAAAAAQSGAGPHYHHHHHHAAGHHHHPTAGAPGAAGSAAASAGGAGGAGGGGPASAGGGGGGGGGGGGGGAAGAGGALHPHHAAGGLHFDDRFSDEQLVTMSVRELNRQLRGVSKEEVIRLKQKRRTLKNRGYAQSCRFKRVQQRHVLESEKNQLLQQVDHLKQEISRLVRERDAYKEKYEKLVSSGFRENGSSSDNPSSPEFFM

SEQ ID NO: 15254 - protein, 256 aa, Homo Sapiens
MKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARSHEFSREPSLSWVVNAVNCSLFSAVREDFKDLKPQLWNAVDEEICLAECDIYSYNPDLDSDPFGEDGSLWSFNYFFYNKRLKRIVFFSCRSISGSTYTPSEAGNELDMELGEEEVEEESRSGGSGAEETSTMEEDRVPVICI

SEQ ID NO: 15255 - protein, 353 aa, Homo Sapiens
MAAELAMGAELPSSPLAIEYVNDFDLMKFEVKKEPPEAERFCHRLPPGSLSSTPLSTPCSSVPSSPSFCAPSPGTGGGGGAGGGGGSSQAGGAPGPPSGGPGAVGGTSGKPALEDLYWMSGYQHHLNPEALNLTPEDAVEALIGSGHHGAHHGAHHPAAAAAYEAFRGPGFAGGGGADDMGAGHHHGAHHAAHHHHAAHHHHHHHHHHGGAGHGGGAGHHVRLEERFSDDQLVSMSVRELNRQLRGFSKEEVIRLKQKRRTLKNRGYAQSCRFKRVQQRHILESEKCQLQSQVEQLKLEVGRLAKERDLYKEKYEKLAGRGGPGSAGGAGFPREPSPPQAGPGGAKGTADFFL

SEQ ID NO: 15256 - protein, 195 aa, Homo Sapiens
MTDSVIYSMLELPTATQAQNDYGPQQKSSSSRPSCSCLVAIALGLLTAVLLSVLLYQWILCQGSNYSTCASCPSCPDRWMKYGNHCYYFSVEEKDWNSSLEFCLARDSHLLVITDNQEMSLLQVFLSEAFCWIGLRNNSGWRWEDGSPLNFSRISSNSFVQTCGAINKNGLQASSCEVPLHWVCKKCPFADQALF

SEQ ID NO: 15257 - protein, 323 aa, Homo Sapiens
MAAELSMGPELPTSPLAMEYVNDFDLLKFDVKKEPLGRAERPGRPCTRLQPAGSVSSTPLSTPCSSVPSSPSFSPTEQKTHLEDLYWMASNYQQMNPEALNLTPEDAVEALIGSHPVPQPLQSFDSFRGAHHHHHHHHPHPHHAYPGAGVAHDELGPHAHPHHHHHHQASPPPSSAASPAQQLPTSHPGPGPHATASATAAGGNGSVEDRFSDDQLVSMSVRELNRHLRGFTKDEVIRLKQKRRTLKNRGYAQSCRYKRVQQKHHLENEKTQLIQQVEQLKQEVSRLARERDAYKVKCEKLANSGFREAGSTSDSPSSPEFFL

SEQ ID NO: 15258 - protein, 164 aa, Homo Sapiens
MSVDPLSSKALKIKRELSENTPHLSDEALMGLSVRELNRHLRGLSAEEVTRLKQRRRTLKNRGYAASCRVKRVCQKEELQKQKSELEREVDKLARENAAMRLELDALRGKCEALQGFARSVAAARGPATLVAPASVITIVKSTPGSGSGPAHGPDPAHGPASCS

SEQ ID NO: 15259 - protein, 162 aa, Homo Sapiens
MTTPNKGNKALKVKREPGENGTSLTDEELVTMSVRELNQHLRGLSKEEIVQLKQRRRTLKNRGYAASCRVKRVTQKEELEKQKAELQQEVEKLASENASMKLELDALRSKYEALQTFARTVARSPVAPARGPLAAGLGPLVPGKVAATSVITIVKSKTDARS

SEQ ID NO: 15260 - protein, 156 aa, Homo Sapiens
MTTNPKPNKALKVKKEAGENAPVLSDDELVSMSVRELNQHLRGLTKEEVTRLKQRRRTLKNRGYAASCRIKRVTQKEELERQRVELQQEVEKLARENSSMRLELDALRSKYEALQTFARTVARGPVAPSKVATTSVITIVKSTELSSTSVPFSAAS

SEQ ID NO: 15261 - protein, 847 aa, Homo Sapiens; identical to SEQ ID NO: 8367

SEQ ID NO: 15262 - protein, 160 aa, Homo Sapiens
MSDNDDIEVESDEEQPRFQSAADKRAHHNALERKRRDHIKDSFHSLRDSVPSLQGEKASRAQILDKATEYIQYMRRKNHTHQQDIDDLKRQNALLEQQVRALEKARSSAQLQTNYPSSDNSLYTNAKGSTISAFDGGSDSSSESEPEEPQSRKKLRMEAS

SEQ ID NO: 15263 - protein, 477 aa, Homo Sapiens; identical to SEQ ID NO: 8384

SEQ ID NO: 15264 - protein, 605 aa, Homo Sapiens
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 15265 - protein, 411 aa, Homo Sapiens
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKGKPDLNTTLPIRQTASIFKQPVTKVTNHPSNKVKSDPQRMNEQPRQLFWEKRLQGLSASDVTEQIIKTMELPKGLQGVGPGSNDETLLSAVASALHTSSAPITGQVSAAVEKNPAVWLNTSQPLCKAFIVTDEDIRKQEERVQQVRKKLEEALMADILSRAADTEEMDIEMDSGDEA

SEQ ID NO: 15266 - protein, 291 aa, Homo Sapiens
MERKRWECPALPQGWEREEVPRRSGLSAGHRDVFYYSPSGKKFRSKPQLARYLGGSMDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 15267 - protein, 194 aa, Homo Sapiens
MAKSSQRKQRDCVNQCKSKPGLSTSIPLRMSSYTFKRPVTRITPHPGNEVRYHQWEESLEKPQQVCWQRRLQGLQAYSSAGELSSTLDLANTLQKLVPSYTGGSLLEDLASGLEHSCPMPHLACSSDAVEIIPAEGVGISQLLCKQFLVTEEDIRKQEGKVKTVRERLAIALIADGLANEAEKVRDQEGRPEKR

SEQ ID NO: 15268 - protein, 208 aa, Homo Sapiens
MGEPAFTSFPSLPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRSPLEPTPGRFPAVAGGPTPGMGCQLPPPLSGQLVTPADIRRQARRVKKARERLAKALQADRLARRAEMLTGG

SEQ ID NO: 15269 - protein, 580 aa, Homo Sapiens
MGTTGLESLSLGDRGAAPTVTSSERLVPDPPNDLRKEDVAMELERVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTGEKIFQEDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGKYGNDSYRIFCVNEWKQVHPEDHKLNKYHDWLWENHEKLSLS

SEQ ID NO: 15270 - protein, 1494 aa, Homo Sapiens
MNGGKECDGGDKEGGLPAIQVPVGWQRRVDQNGVLYVSPSGSLLSCLEQVKTYLLTDGTCKCGLECPLILPKVFNFDPGAAVKQRTAEDVKADEDVTKLCIHKRKIIAVATLHKSMEAPHPSLVLTSPGGGTNATPVVPSRAATPRSVRNKSHEGITNSVMPECKNPFKLMIGSSNAMGRLYVQELPGSQQQELHPVYPRQRLGSSEHGQKSPFRGSHGGLPSPASSGSQIYGDGSISPRTDPLGSPDVFTRSNPGFHGAPNSSPIHLNRTPLSPPSVMLHGSPVQSSCAMAGRTNIPLSPTLTTKSPVMKKPMCNFSTNMEIPRAMFHHKPPQGPPPPPPPSCALQKKPLTSEKDPLGILDPIPSKPVNQNPVIINPTSFHSNVHSQVPMMNVSMPPAVVPLPSNLPLPTVKPGHMNHGSHVQRVQHSASTSLSPSPVTSPVHMMGTGIGRIEASPQRSRSSSTSSDHGNFMMPPVGPQATSSGIKVPPRSPRSTIGSPRPSMPSSPSTKSDGHHQYKDIPNPLIAGISNVLNTPSSAAFPTASAGSSSVKSQPGLLGMPLNQILNQHNAASFPASSLLSAAAKAQLANQNKLAGNNSSSSSNSGAVAGSGNTEGHSTLNTMFPPTANMLLPTGEGQSGRAALRDKLMSQQKDALRKRKQPPTTVLSLLRQSQMDSSAVPKPGPDLLRKQGQGSFPISSMSQLLQSMSCQSSHLSSNSTPGCGASNTALPCSANQLHFTDPSMNSSVLQNIPLRGEAVHCHNANTNFVHSNSPVPNHHLAGLINQIQASGNCGMLSQSGMALGNSLHPNPPQSRISTSSTPVIPNSIVSSYNQTSSEAGGSGPSSSIAIAGTNHPAITKTTSVLQDGVIVTTAAGNPLQSQLPIGSDFPFVGQEHALHFPSNSTSNNHLPHPLNPSLLSSLPISLPVNQQHLLNQNLLNILQPSAGEGDMSSINNTLSNHQLTHLQSLLNNNQMFPPNQQQQQLLQGYQNLQAFQGQSTIPCPANNNPMACLFQNFQVRMQEDAALLNKRISTQPGLTALPENPNTTLPPFQDTPCELQPRIDPSLGQQVKDGLVVGGPGDASVDAIYKAVVDAASKGMQVVITTAVNSTTQISPIPALSAMSAFTASIGDPLNLSSAVSAVIHGRNMGGVDHDGRLRNSRGARLPKNLDHGKNVNEGDGFEYFKSASCHTSKKQWDGEQSPRGERNRWKYEEFLDHPGHIHSSPCHERPNNVSTLPFLPGEQHPILLPPRNCPGDKILEENFRYNNYKRTMMSFKERLENTVERCAHINGNRPRQSRGFGELLSTAKQDLVLEEQSPSSSNSLENSLVKDYIHYNGDFNAKSVNGCVPSPSDAKSISSEDDLRNPDSPSSNELIHYRPRTFNVGDLVWGQIKGLTSWPGKLVREDDVHNSCQQSPEEGKVEPEKLKTLTEGLEAYSRVRKRNRKSGKLNNHLEAAIHEAMSELDKMSGTVHQIPQGDRQMRPPKPKRRKISR

SEQ ID NO: 15271 - protein, 1003 aa, Homo Sapiens; identical to SEQ ID NO: 8402

SEQ ID NO: 15272 - protein, 354 aa, Homo Sapiens
MTAVNVALIRDTKWLTLEVCREFQRGTCSRADADCKFAHPPRVCHVENGRVVACFDSLKGRCTRENCKYLHPPPHLKTQLEINGRNNLIQQKTAAAMFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAGPILCMAPASNIVPMMHGATPTTVSAATTPATSVPFAAPTTGNQLKF

SEQ ID NO: 15273 - protein, 1230 aa, Homo Sapiens
MRSKGRARKLATNNECVYGNYPEIPLEEMPDADGVASTPSLNIQEPCSPATSSEAFTPKEGSPYKAPIYIPDDIPIPAEFELRESNMPGAGLGIWTKRKIEVGEKFGPYVGEQRSNLKDPSYGWEILDEFYNVKFCIDASQPDVGSWLKYIRFAGCYDQHNLVACQINDQIFYRVVADIAPGEELLLFMKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 15274 - protein, 486 aa, Homo Sapiens
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHSESPKAPVPLLPPLPPPPPEPESSEDPTSPPEPQDLSSSVCKEEKMPRGGSLESDGCPKEPAKTQPAVATAATAAEKYKHRGEGERKDIVSSSMPRPNREEPVDSRTPVTERVS

SEQ ID NO: 15275 - protein, 507 aa, Homo Sapiens
MGRKKIQITRIMDERNRQVTFTKRKFGLMKKAYELSVLCDCEIALIIFNSSNKLFQYASTDMDKVLLKYTEYNEPHESRTNSDIVEALNKKEHRGCDSPDPDTSYVLTPHTEEKYKKINEEFDNMMRNHKIAPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLSEEEELELNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 15276 - protein, 365 aa, Homo Sapiens
MGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPVGAEAWARRVPQPAAPPRRPPQSASSLSASLRPPGAPATFLRPSPIPCSSPGPWQSLCGLGPPCAGCPWPTAGPGRRSPGGTSPERSPGTARARGDPTSLQASSEKTQQ

SEQ ID NO: 15277 - protein, 473 aa, Homo Sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 15278 - protein, 521 aa, Homo Sapiens
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLTEDHLDLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 15279 - protein, 390 aa, Homo Sapiens; identical to SEQ ID NO: 8520

SEQ ID NO: 15280 - protein, 477 aa, Homo Sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGLQSMPGDYVSQGGPMGMSMAQPSYTPPQMTPHPTQLRHGPPMHSYLPSHPHHPAMMMHGGPPTHPGMTMSAQSPTMLNSVDPNVGGQVMDIHAQ

SEQ ID NO: 15281 - protein, 375 aa, Homo Sapiens; identical to SEQ ID NO: 8528

SEQ ID NO: 15282 - protein, 274 aa, Homo Sapiens
MGPELGWGHPRGGDVCSSDSFNEDNTAFAKQVRSERPFFSSNPELDNLMIQAIQVLRFHLLELEKGKMPIDLVIEDRDGGCREDFEDYPASCPSLPDQNNIWIRDHEDSGSVHLGTPGPSSGGLASQSGDNSSDQGVGLDTSVASPSSGGEDEDLDQEPRRNKKRGIFPKVATNIMRAWLFQHLSHPYPSEEQKKQLAQDTGLTILQVNNWFINARRRIVQPMIDQSNRTGQGAAFSPEGQPIGGYTETEPHVAFRAPASVGMSLNSEGEWHYL

SEQ ID NO: 15283 - protein, 358 aa, Homo Sapiens
MARRYDELPHYPSIADGPAALAGFPEAVPAAPGPYGPHRPPQPLPPGLDSDGLKRDKDEIYGHPLFPLLALVFEKCELATCSPRDGAGAGLGTPRGGDVCSSDSFNEDNTAFAKQVRSERPFFSSNPELDNLMIQAIQVLRFHLLELEKGKMPIDLVIEDRDGGCREDFEDYPASCLSLPDQNNIWIRDHEDSGSVHLGTPGPSSGGLASQSGDNSSDQGVGLDTSVASPSSGGEDEDLDQEPRRNKKRGIFPKVATNIMRAWLFQHLWHPYPSEEQKKQLVQDTGLTILQVNNWFINARRRMVQPMIDQSNRIGQGAAFSPEGQPIGGYTETEPHVAFRPPASVGMSLNLEGEWHYL

SEQ ID NO: 15284 - protein, 254 aa, Homo Sapiens
MDPAASSCMRSLQPPAPVWGCLRNPHSEGNGASGLPHYPPTPFSFHQKPDFLATATAAYPDFSASCLAATPHSLPQEEHIFTEQHPAFPQSPNWHFPVSDARRRPNSGPAGGSKEMGTSSLGLVDTTGGPGDDYGVLGSTANETEKKSSRRRKESSDNQENRGKPEGSSKARKERTAFTKEQLRELEAEFAHHNYLTRLRRYEIAVNLDLSERQVKVWFQNRRMKWKRVKGGQPISPNGQDPEDGDSTASPSSE

SEQ ID NO: 15285 - protein, 304 aa, Homo Sapiens
MEHPLFGCLRSPHATAQGLHPFSQSSLALHGRSDHMSYPELSTSSSSCIIAGYPNEEGMFASQHHRGHHHHHHHHHHHHHQQQQHQALQTNWHLPQMSSPPSAARHSLCLQPDSGGPPELGSSPPVLCSNSSSLGSSTPTGAACAPGDYGRQALSPAEAEKRSGGKRKSDSSDSQEGNYKSEVNSKPRKERTAFTKEQIRELEAEFAHHNYLTRLRRYEIAVNLDLTERQVKVWFQNRRMKWKRVKGGQQGAAAREKELVNVKKGTLLPSELSGIGAATLQQTGDSIANEDSHDSDHSSEHAHL

SEQ ID NO: 15286 - protein, 268 aa, Homo Sapiens
MAQPLCPPLSESWMLSAAWGPTRRPPPSDKDCGRSLVSSPDSWGSTPADSPVASPARPGTLRDPRAPSVGRRGARSSRLGSGQRQSASEREKLRMRTLARALHELRRFLPPSVAPAGQSLTKIETLRLAIRYIGHLSAVLGLSEESLQRRCRQRGDAGSPRGCPLCPDDCPAQMQTRTQAEGQGQGRGLGLVSAVRAGASWGSPPACPGARAAPEPRDPPALFAEAACPEGQAMEPSPPSPLLPGDVLALLETWMPLSPLEWLPEEPK

SEQ ID NO: 15287 - protein, 397 aa, Homo Sapiens
MAQSPPPQSLLGHDHWIFAQGWGWAGHWDSTSPASSSDSSGSCPCDGARGLPQPQPPSCSSRAAEAAATTPRRARTGPAGGQRQSASEREKLRMRTLARALHELRRFLPPSLAPAGQSLTKIETLRLAIRYIGHLSAVLGLSEESLQCRRRQRGDAGSPWGCPLCPDRGPAEAQTQAEGQGQGQGQGQGQGQGQGQGQGQGQGQGRRPGLVSAVLAEASWGSPSACPGAQAAPERLGRGVHDTDPWATPPYCPKIQSPPYSSQGTTSDASLWTPPQGCPWTQSSPEPRNPPVPWTAAPATLELAAVYQGLSVSPEPCLSLGAPSLLPHPSCQRLQPQTPGRCWSHSAEVVPNSEDQGPGAAFQLSEASPPQSSGLRFSGCPELWQEDLEGARLGIFY

SEQ ID NO: 15288 - protein, 1857 aa, Homo Sapiens
MARKKLKKFTTLEIVLSVLLLVLFIISIVLIVLLAKESLKSTAPDPGTTGTPDPGTTGTPDPGTTGTTHARTTGPPDPGTTGTTPVSAECPVVNELERINCIPDQPPTKATCDQRGCCWNPQGAVSVPWCYYSKNHSYHVEGNLVNTNAGFTARLKNLPSSPVFGSNVDNVLLTAEYQTSNRFHFKLTDQTNNRFEVPHEHVQSFSGNAAASLTYQVEISRQPFSIKVTRRSNNRVLFDSSIGPLLFADQFLQLSTRLPSTNVYGLGEHVHQQYRHDMNWKTWPIFNRDTTPNGNGTNLYGAQTFFLCLEDASGLSFGVFLMNSNAMEVVLQPAPAITYRTIGGILDFYVFLGNTPEQVVQEYLELIGRPALPSYWALGFHLSRYEYGTLDNMREVVERNRAAQLPYDVQHADIDYMDERRDFTYDSVDFKGFPEFVNELHNNGQKLVIIVDPAISNNSSSSKPYGPYDRGSDMKIWVNSSDGVTPLIGEVWPGQTVFPDYTNPNCAVWWTKEFELFHNQVEFDGIWIDMNEVSNFVDGSVSGCSTNNLNNPPFTPRILDGYLFCKTLCMDAVQHWGKQYDIHNLYGYSMAVATAEAAKTVFPNKRSFILTRSTFAGSGKFAAHWLGDNTATWDDLRWSIPGVLEFNLFGIPMVGPDICGFALDTPEELCRRWMQLGAFYPFSRNHNGQGYKDQDPASFGADSLLLNSSRHYLNIRYTLLPYLYTLFFRAHSRGDTVARPLLHEFYEDNSTWDVHQQFLWGPGLLITPVLDEGAEKVMAYVPDAVWYDYETGSQVRWRKQKVEMELPGDKIGLHLRGGYIFPTQQPNTTTLASRKNPLGLIIALDENKEAKGELFWDNGETKDTVANKVYLLCEFSVTQNRLEVNISQSTYKDPNNLAFNEIKILGTEEPSNVTVKHNGVPSQTSPTVTYDSNLKVAIITDIDLLLGEAYTVEWSIKIRDEEKIDCYPDENGASAENCTARGCIWEASNSSGVPFCYFVNDLYSVSDVQYNSHGATADISLKSSVYANAFPSTPVNPLRLDVTYHKNEMLQFKIYDPNKNRYEVPVPLNIPSMPSSTPEGQLYDVLIKKNPFGIEIRRKSTGTIIWDSQLLGFTFSDMFIRISTRLPSKYLYGFGETEHRSYRRDLEWHTWGMFSRDQPPGYKKNSYGVHPYYMGLEEDGSAHGVLLLNSNAMDVTFQPLPALTYRTTGGVLDFYVFLGPTPELVTQQYTELIGRPVMVPYWSLGFQLCRYGYQNDSEIASLYDEMVAAQIPYDVQYSDIDYMERQLDFTLSPKFAGFPALINRMKADGMRVILILDPAISGNETQPYPAFTRGVEDDVFIKYPNDGDIVWGKVWPDFPDVVVNGSLDWDSQVELYRAYVAFPDFFRNSTAKWWKREIEELYNNPQNPERSLKFDGMWIDMNEPSSFVNGAVSPGCRDASLNHPPYMPHLESRDRGLSSKTLCMESQQILPDGSLVQHYNVHNLYGWSQTRPTYEAVQEVTGQRGVVITRSTFPSSGRWAGHWLGDNTAAWDQLKKSIIGMMEFSLFGISYTGADICGFFQDAEYEMCVRWMQLGAFYPFSRNHNTIGTRRQDPVSWDVAFVNISRTVLQTRYTLLPYLYTLMHKAHTEGVTVVRPLLHEFVSDQVTWDIDSQFLLGPAFLVSPVLERNARNVTAYFPRARWYDYYTGVDINARGEWKTLPAPLDHINLHVRGGYILPWQEPALNTHLSRQKFMGFKIALDDEGTAGGWLFWDDGQSIDTYGKGLYYLASFSASQNTMQSHIIFNNYITGTNPLKLGYIEIWGVGSVPVTSVSISVSGMVITPSFNNDPTTQVLSIDVTDRNISLHNFTSLTWISTL

SEQ ID NO: 15289 - protein, 3026 aa, Homo Sapiens
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKRKKLEYTICETEPEQPVRHYPLWVKVEGEVDPEPVYIPTPSVIEPMKPLLLPQPEVLSPTVKGKLLTGIKSPRSYTPKPNPVIREEDKDPVYLYFESMMTCARVRVYERKKEDQRQPSSSSSPSPSFQQQTSCHSSPENHNNAKEPDSEQQPLKQLTCDLEDDSDKLQEKSWKSSCNEGESSSTSYMHQRSPGGPTKLIEIISDCNWEEDRNKILSILSQHINSNMPQSLKVGSFIIELASQRKSRGEKNPPVYSSRVKISMPSCQDQDDMAEKSGSETPDGPLSPGKMEDISPVQTDALDSVRERLHGGKGLPFYAGLSPAGKLVAYKRKPSSSTSGLIQVASNAKVAASRKPRTLLPSTSNSKMASSSGTATNRPGKNLKAFVPAKRPIAARPSPGGVFTQFVMSKVGALQQKIPGVSTPQTLAGTQKFSIRPSPVMVVTPVVSSEPVQVCSPVTAAVTTTTPQVFLENTTAVTPMTAISDVETKETTYSSGATTTGVVEVSETNTSTSVTSTQSTATVNLTKTTGITTPVASVAFPKSLVASPSTITLPVASTASTSLVVVTAAASSSMVTTPTSSLGSVPIILSGINGSPPVSQRPENAAQIPVATPQVSPNTVKRAGPRLLHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 15290 - protein, 512 aa, Homo Sapiens; identical to SEQ ID NO: 8725

SEQ ID NO: 15291 - protein, 545 aa, Homo Sapiens
MAEASSLGRQSPRVVSCLEHSLCPGEPGLQTTAVVSMGSGDHQFNLAEILSQNYSVRGECEEASRCPDKPKEELEKDFISQSNDMPFDELLALYGYEASDPISDRESEGGDVAPNLPDMTLDKEQIAKDLLSGEEEEETQSSADDLTPSVTSHEASDLFPNRSGSRFLADEDREPGSSASSDTEEDSLPANKCKKEIMVGPQFQADLSNLHLNRHCEKIYENEDQLLWDPSVLPEREVEEFLYRAVKRRWHEMAGPQLPEGEAVKDSEQALYELVKCNFNVEEALRRLRFNVKVIRDGLCAWSEEECRNFEHGFRVHGKNFHLIQANKVRTRSVGECVEYYYLWKKSERYDYFAQQTRLGRRKYVPSGTTDADQDLDGSDPDGPGRPRPEQDTLTGMRTDPLSVDGTAGGLDEPGVASDGLPSSEPGPCSFQQLDESPAVPLSHRPPALADPASYQPAVTAPEPDASPRLAVDFALPKELPLISSHVDLSGDPEETVAPAQVALSVTEFGLIGIGDVNPFLAAHPTCPAPGLHSEPLSHCNVMTC

SEQ ID NO: 15292 - protein, 550 aa, Homo Sapiens
MAEASFGSSSPVGSLSSEDHDFDPTAEMLVHDYDDERTLEEEEMMDEGKNFSSEIEDLEKEGTMPLEDLLAFYGYEPTIPAVANSSANSSPSELADELPDMTLDKEEIAKDLLSGDDEETQSSADDLTPSVTSHETSDFFPRPLRSNTACDGDKESEVEDVETDSGNSPEDLRKEIMIGLQYQAEIPPYLGEYDGNEKVYENEDQLLWCPDVVLESKVKEYLVETSLRTGSEKIMDRISAGTHTRDNEQALYELLKCNHNIKEAIERYCCNGKASQEGMTAWTEEECRSFEHALMLFGKDFHLIQKNKVRTRTVAECVAFYYMWKKSERYDYFAQQTRFGKKRYNHHPGVTDYMDRLVDETEALGGTVNASALTSNRPEPIPDQQLNILNSFTASDLTALTNSVATVCDPTDVNCLDDSFPPLGNTPRGQVNHVPVVTEELLTLPSNGESDCFNLFETGFYHSELNPMNMCSEESERPAKRLKMGIAVPESFMNEVSVNNLGVDFENHTHHITSAKMAVSVADFGSLSANETNGFISAHALHQHAALHSE

SEQ ID NO: 15293 - protein, 1132 aa, Homo Sapiens
MIATPLKHSRIYLPPEASSQRRNLPMDAIFFDSIPSGTLTPVKDLVKYQNSSLKLNDHKKNQFLKMTTFNNKNIFQSTMLTEATTSNSSLDISAIKPNKDGLKNKANYESPGKIFLRMKEKVLRDKQEQPSRNSSLLEPQKSGNNETFTPNRVEKKKLQHTYLCEEKENNKSFQSDDSSLRASVQGVPLESSNNDIFLPVKQKIQCQQEKKAPLHNLTYELPTLNQEQENFLAVEARNKTLTRAQLAKQIFHSKESIVATTKSKKDTFVLESVDSADEQFQNTNAETLSTNCIPIKNGSLLMVSDSERTTEGTSQQKVKEGNGKTVPGETGLPGSMKDTCKIVLATPRLHITIPRRSKRNISKLSPPRIFQTVTNGLKKNQVVQLQEWMIKSINNNTAICVEGKLIDVTNIYWHSNVIIERIEHNKLRTISGNVYILKGMIDQISMKEAGYPNYLIRKFMFGFPENWKEHIDNFLEQLRAGEKNREKTKQKQKTGRSVRDIRKSMKNDARENQTDTAQRATTTYDFDCDNLELKSNKHSESPGATELNMCHSNCQNKPTLRFPDDQVNNTIQNGGGDDLSNQELIGKKEYKMSSKKLKIGERTNERIIKSQKQETTEELDVSIDILTSREQFFSDEERKYMAINQKKAYILVTPLKSRKVIEQRCMRYNLSAGTIKAVTDFVIPECQKKSPISKSMGTLENTFEGHKSKNKEDCDERDLLTVNRKIKISNLEKEQMLTSDFKKNTRLLPKLKKIENQVAMSFYKHQSSPDLSSEESETEKEIKRKAEVKKTKAGNTKEAVVHLRKSTRNTSNIPVILEPETEESENEFYIKQKKARPSVKETLQKSGVRKEFPITEAVGSDKTNRHPLECLPGLIQDKEWNEKELQKLHCAFASLPKHKPGFWSEVAAAVGSRSPEECQRKYMENPRGKGSQKHVTKKKPANSKGQNGKRGDADQKQTIKITAKVGTLKRKQQMREFLEQLPKDDHDDFFSTTPLQHQRILLPSFQDSEDDDDILPNMDKNPTTPSSVIFPLVKTPQCQHVSPGMLGSINRNDCDKYVFRMQKYHKSNGGIVWGNIKKKLVETDFSTPTPRRKTPFNTDLGENSGIGKLFTNAVESLDEEEKDYYFSNSDSA

SEQ ID NO: 15294 - protein, 526 aa, Homo Sapiens
MQSESGIVPDFEVGEEFHEEPKTYYELKSQPLKSSSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTACIFPTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 15295 - protein, 232 aa, Homo Sapiens
MATAESRALQFAEGAAFPAYRAPHAGGALLPPPSPAAALLPAPPAGPGPATFAGFLGRDPGPAPPPPASLGSPAPPKGAAAPSASQRRKRTSFSAEQLQLLELVFRRTRYPDIHLRERLAALTLLPESRIQVWFQNRRAKSRRQSGKSFQPLARPEIILNHCAPGTETKCLKPQLPLEVDVNCLPEPNGVGGGISDSSSQGQNFETCSPLSEDIGSKLDSWEEHIFSAFGNF

SEQ ID NO: 15296 - protein, 352 aa, Homo Sapiens
MNTIVFNKLSGAVLFEDGGASERERGGRPYSGVLDSPHARPEVGIPDGPPLKDNLGLRHRRTGARQNGGKVRHKRQALQDMARPLKQWLYKHRDNPYPTKTEKILLALGSQMTLVQVSNWFANARRRLKNTVRQPDLSWALRIKLYNKYVQGNAERLSVSSDDSCSEDGENPPRTHMNEGGYNTPVHHPVIKSENSVIKAGVRPESRASEDYVAPPKYKSSLLNRYLNDSLRHVMATNTTMMGKTRQRNHSGSFSSNEFEEELVSPSSSETEGNFVYRTDTLENGSNKGESAANRKGPSKDDTYWKEINAAMALTNLAQGKDKLQGTTSCIIQKSSHIAEVKTVKVPLVQQF

SEQ ID NO: 15297 - protein, 559 aa, Homo Sapiens
MDNQCTVQVRLELGHRAQLRKKPTTEGFTHDWMVFVRGPEQCDIQHFVEKVVFWLHDSFPKPRRVCKEPPYKVEESGYAGFIMPIEVHFKNKEEPRKVCFTYDLFLNLEGNPPVNHLRCEKLTFNNPTTEFRYKLLRAGGVMVMPEGADTVSRPSPDYPMLPTIPLSAFSDPKKTKPSHGSKDANKESSKTSKPHKVTKEHRERPRKDSESKSSSKELEREQAKSSKDTSRKLGEGRLPKEEKAPPPKAAFKEPKMALKETKLESTSPKGGPPPPPPPPPRASSKRPATADSPKPSAKKQKKSSSKGSRSAPGTSPRTSSSSSFSDKKPAKDKSSTRGEKVKAESEPREAKKALEVEESNSEDEASFKSESAQSSPSNSSSSSDSSSDSDFEPSQNHSQGPLRSMVEDLQSEESDEDDSSSGEEAAGKTNPGRDSRLSFSDSESDNSADSSLPSREPPPPQKPPPPNSKVSGRRSPESCSKPEKILKKGTYDKAYTDELVELHRRLMALRERNVLQQIVNLIEETGHFNVTNTTFDFDLFSLDETTVRKLQSCLEAVAT

SEQ ID NO: 15298 - protein, 1068 aa, Homo Sapiens
MVSSDRPVSLEDEVSHSMKEMIGGCCVCSDERGWAENPLVYCDGHGCSVAVHQACYGIVQVPTGPWFCRKCESQERAARVRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPEQHQAFLYQLMQHHHQQHHQPELQQLQIPGPTQIPINNLLAGTQAPPLHTATTNPFLTIHGDNASQKVARLSDKTGPVAQEKS

SEQ ID NO: 15299 - protein, 90 aa, Homo Sapiens
MRDPVSSQYSSFLFWRMPIPELDLSELEGLGLSDTATYKVKDSSVGKMIGQATAADQEKNPEGDGLLEYSTFNFWRAPIASIHSFELDLL

SEQ ID NO: 15300 - protein, 568 aa, Homo Sapiens
MASSCAVQVKLELGHRAQVRKKPTVEGFTHDWMVFVRGPEHSNIQHFVEKVVFHLHESFPRPKRVCKDPPYKVEESGYAGFILPIEVYFKNKEEPRKVRFDYDLFLHLEGHPPVNHLRCEKLTFNNPTEDFRRKLLKAGGDPNRSIHTSSSSSSSSSSSSSSSSSSSSSSSSSSSSSSSSSSSSSSSSSSTSFSKPHKLMKEHKEKPSKDSREHKSAFKEPSRDHNKSSKESSKKPKENKPLKEEKIVPKMAFKEPKPMSKEPKPDSNLLTITSGQDKKAPSKRPPISDSEELSAKKRKKSSSEALFKSFSSAPPLILTCSADKKQIKDKSHVKMGKVKIESETSEKKKSTLPPFDDIVDPNDSDVEENISSKSDSEQPSPASSSSSSSSSFTPSQTRQQGPLRSIMKDLHSDDNEEESDEVEDNDNDSEMERPVNRGGSRSRRVSLSDGSDSESSSASSPLHHEPPPPLLKTNNNQILEVKSPIKQSKSDKQIKNGECDKAYLDELVELHRRLMTLRERHILQQIVNLIEETGHFHITNTTFDFDLCSLDKTTVRKLQSYLETSGTS

SEQ ID NO: 15301 - protein, 1824 aa, Homo Sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPGRRNHFAYYNYHTYEDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARLQDEERRRQQQLEEMRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGPNSYPGSTGAAVGAHDACRDAKEKRSKSQDADSPGSSGAPENLTFKERQRLFSQGQDVSNKVKASRKLTELENELNTK

SEQ ID NO: 15302 - protein, 1093 aa, Homo Sapiens
MKEMVGGCCVCSDERGWAENPLVYCDGHACSVAVHQACYGIVQVPTGPWFCRKCESQERAARVRCELCPHKDGALKRTDNGGWAHVVCALYIPEVQFANVLTMEPIVLQYVPHDRFNKTCYICEEQGRESKAASGACMTCNRHGCRQAFHVTCAQMAGLLCEEEVLEVDNVKYCGYCKYHFSKMKTSRHSSGGGGGGAGGGGGSMGGGGSGFISGRRSRSASPSTQQEKHPTHHERGQKKSRKDKERLKQKHKKRPESPPSILTPPVVPTADKVSSSASSSSHHEASTQETSESSRESKGKKSSSHSLSHKGKKLSSGKGVSSFTSASSSSSSSSSSSGGPFQPAVSSLQSSPDFSAFPKLEQPEEDKYSKPTAPAPSAPPSPSAPEPPKADLFEQKVVFSGFGPIMRFSTTTSSSGRARAPSPGDYKSPHVTGSGASAGTHKRMPALSATPVPADETPETGLKEKKHKASKRSRHGPGRPKGSRNKEGTGGPAAPSLPSAQLAGFTATAASPFSGGSLVSSGLGGLSSRTFGPSGSLPSLSLESPLLGAGIYTSNKDPISHSGGMLRAVCSTPLSSSLLGPPGTSALPRLSRSPFTSTLPSSSASISTTQVFSLAGSTFSLPSTHIFGTPMGAVNPLLSQAESSHTEPDLEDCSFRCRGTSPQESLSSMSPISSLPALFDQTASAPCGGGQLDPAAPGTTNMEQLLEKQGDGEAGVNIVEMLKALHALQKENQRLQEQILSLTAKKERLQILNVQLSVPFPALPAALPAANGPVPGPYGLPPQAGSSDSLSTSKSPPGKSSLGLDNSLSTSSEDPHSGCPSRSSSSLSFHSTPPPLPLLQQSPATLPLALPGAPAPLPPQPQNGLGRAPGAAGLGAMPMAEGLLGGLAGSGGLPLNGLLGGLNGAAAPNPASLSQAGGAPTLQLPGCLNSLTEQQRHLLQQQEQQLQQLQQLLASPQLTPEHQTVVYQMIQQIQQKRELQRLQMAGGSQLPMASLLAGSSTPLLSAGTPGLLPTASAPPLLPAGALVAPSLGNNTSLMAAAAAAAAVAAAGGPPVLTAQTNPFLSLSGAEGSGGGPKGGTADKGASANQEKG

SEQ ID NO: 15303 - protein, 298 aa, Homo Sapiens
MTEPGASPEDPWVKASPVGAHAGEGRAGRARARRGAGRRGASLLSPKSPTLSVPRGCREDSSHPACAKVEYAYSDNSLDPGLFVESTRKGSVVSRANSIGSTSASSVPNTDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 15304 - protein, 919 aa, Homo Sapiens; identical to SEQ ID NO: 8747

SEQ ID NO: 15305 - protein, 852 aa, Homo Sapiens; identical to SEQ ID NO: 8755

SEQ ID NO: 15306 - protein, 582 aa, Homo Sapiens
MSIETLLEAARFLEWQAQQQQRAREEQERLRLEQEREQEQKKANSLARLAHTLPVEEPRMEAPPLPLSPPAPPPAPPPPLATPAPLTVIPIPVVTNSPQPLPPPPPLPAAAQPLPLAPRQPALVGAPGLSIKEPAPLPSRPQVPTPAPLLPDSKATIPPNGSPKPLQPLPTPVLTIAPHPGVQPQLAPQQPPPPTLGTLKLAPAEEVKSSEQKKRPGGIGTREVHNKLEKNRRAHLKECFETLKRNIPNVDDKKTSNLSVLRTALRYIQSLKRKEKEYEHEMERLAREKIATQQRLAELKHELSQWMDVLEIDRVLRQTGQPEDDQASTSTASEGEDNIDEDMEEDRAGLGPPKLSHRPQPELLKSTLPPPSTTPAPLPPHPHPHPHSVALPPAHLPVQQQQPQQKTPLPAPPPPPAAPAQTLVPAPAHLVATAGGGSTVIAHTATTHASVIQTVNHVLQGPGGKHIAHIAPSAPSPAVQLAPATPPIGHITVHPATLNHVAHLGSQLPLYPQPVAVSHIAHTLSHQQVNGTAGLGPPATVMAKPAVGAQVVHHPQLVGQTVLNPVTMVTMPSFPVSTLKLA

SEQ ID NO: 15307 - protein, 401 aa, Homo Sapiens
MEKSKNFRIDALLAVDPPRAASAQSAPLALVTSLAAAASGTGGGGGGGGASGGTSGSCSPASSEPPAAPADRLRAESPSPPRLLAAHCALLPKPGFLGAGGGGGGTGGGHGGPHHHAHPGAAAAAAAAAAAAAAGGLALGLHPGGAQGGAGLPAQAALYGHPVYGYSAAAAAAALAGQHPALSYSYPQVQGAHPAHPADPIKLGAGTFQLDQWLRASTAGMILPKMPDFNSQAQSNLLGKCRRPRTAFTSQQLLELEHQFKLNKYLSRPKRFEVATSLMLTETQVKIWFQNRRMKWKRSKKAKEQAAQEAEKQKGGGGGAGKGGAEEPGAEELLGPPAPGDKGSGRRLRDLRDSDPEEDEDEDDEDHFPYSNGASVHAASSDCSSEDDSPPPRPSHQPAPQ

SEQ ID NO: 15308 - protein, 206 aa, Homo Sapiens
MSTGSVSDPEEMELRGLQREYPVPASKRPPLRGVERSYASPSDNSSAEEEDPDGEEERCALGTAGSAEGCKRKRPRVAGGGGAGGSAGGGGKKPLPAKGSAAECKQSQRNAANARERARMRVLSKAFSRLKTSLPWVPPDTKLSKLDTLRLASSYIAHLRQLLQEDRYENGYVHPVNLTWPFVVSGRPDSDTKEVSAANRLCGTTA

SEQ ID NO: 15309 - protein, 193 aa, Homo Sapiens
MDNLRETFLSLEDGLGSSDSPGLLSSWDWKDRAGPFELNQASPSQSLSPAPSLESYSSSPCPAVAGLPCEHGGASSGGSEGCSVGGASGLVEVDYNMLAFQPTHLQGGGGPKAQKGTKVRMSVQRRRKASEREKLRMRTLADALHTLRNYLPPVYSQRGQPLTKIQTLKYTIKYIGELTDLLNRGREPRAQSA

SEQ ID NO: 15310 - protein, 303 aa, Homo Sapiens
MAPAADMTSLPLGVKVEDSAFGKPAGGGAGQAPSAAAATAAAMGADEEGAKPKVSPSLLPFSVEALMADHRKPGAKESALAPSEGVQAAGGSAQPLGVPPGSLGAPDAPSSPRPLGHFSVGGLLKLPEDALVKAESPEKPERTPWMQSPRFSPPPARRLSPPACTLRKHKTNRKPRTPFTTAQLLALERKFRQKQYLSIAERAEFSSSLSLTETQVKIWFQNRRAKAKRLQEAELEKLKMAAKPMLPPAAFGLSFPLGGPAAVAAAAGASLYGASGPFQRAALPVAPVGLYTAHVGYSMYHLT

SEQ ID NO: 15311 - protein, 267 aa, Homo Sapiens
MASPSKGNDLFSPDEEGPAVVAGPGPGPGGAEGAAEERRVKVSSLPFSVEALMSDKKPPKEASPLPAESASAGATLRPLLLSGHGAREAHSPGPLVKPFETASVKSENSEDGAAWMQEPGRYSPPPRHMSPTTCTLRKHKTNRKPRTPFTTSQLLALERKFRQKQYLSIAERAEFSSSLNLTETQVKIWFQNRRAKAKRLQEAELEKLKMAAKPMLPSSFSLPFPISSPLQAASIYGASYPFHRPVLPIPPVGLYATPVGYGMYHLS

SEQ ID NO: 15312 - protein, 715 aa, Homo Sapiens
MAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYTTQSYQWYSWGPPNMQCRLCASCWTYWKKYGGLKMPTRLDGERPGPNRSNMSPHGLPARSSGSPKFAMKTRQAFYLHTTKLTRIARRLCREILRPWHAARHPYLPINSAAIKAECTARLPEASQSPLVLKQAVRKPLEAVLRYLETHPRPPKPDPVKSVSSVLSSLTPAKVAPVINNGSPTILGKRSYEQHNGVDGNMKKRLLMPSRGLANHGQARHMGPSRNLLLNGKSYPTKVRLIRGGSLPPVKRRRMNWIDAPDDVFYMATEETRKIRKLLSSSETKRAARRPYKPIALRQSQALPPRPPPPAPVNDEPIVIED

SEQ ID NO: 15313 - protein, 668 aa, Homo Sapiens
MAANMYRVGDYVYFENSSSNPYLVRRIEELNKTANGNVEAKVVCLFRRRDISSSLNSLADSNAREFEEESKQPGVSEQQRHQLKHRELFLSRQFESLPATHIRGKCSVTLLNETDILSQYLEKEDCFFYSLVFDPVQKTLLADQGEIRVGCKYQAEIPDRLVEGESDNRNQQKMEMKVWDPDNPLTDRQIDQFLVVARAVGTFARALDCSSSIRQPSLHMSAAAASRDITLFHAMDTLQRNGYDLAKAMSTLVPQGGPVLCRDEMEEWSASEAMLFEEALEKYGKDFNDIRQDFLPWKSLASIVQFYYMWKTTDRYIQQKRLKAAEADSKLKQVYIPTYTKPNPNQIISVGSKPGMNGAGFQKGLTCESCHTTQSAQWYAWGPPNMQCRLCASCWIYWKKYGGLKTPTQLEGATRGTTEPHSRGHLSRPEAQSLSPYTTSANRAKLLAKNRQTFLLQTTKLTRLARRMCRDLLQPRRAARRPYAPINANAIKAECSIRLPKAAKTPLKIHPLVRLPLATIVKDLVAQAPLKPKTPRGTKTPINRNQLSQNRGLGGIMVKRAYETMAGAGVPFSANGRPLASGIRSSSQPAAKRQKLNPADAPNPVVFVATKDTRALRKALTHLEMRRAARRPNLPLKVKPTLIAVRPPVPLPAPSHPASTNEPIVLED

SEQ ID NO: 15314 - protein, 594 aa, Homo Sapiens
MAANMYRVGDYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAEYADRHAELSGSPLKSKSTRKPLACIIGYLEIHPAKKPNVIRSTPSLQTPTTKRMLTTPNHTSLSILGKRNYSHHNGLDELTCCVSD

SEQ ID NO: 15315 - protein, 753 aa, Homo Sapiens
MGEHSPDNNIIYFEAEEDELTPDDKMLRFVDKNGLVPSSSGTVYDRTTVLIEQDPGTLEDEDDDGQCGEHLPFLVGGEEGFHLIDHEAMSQGYVQHIISPDQIHLTINPGSTPMPRNIEGATLTLQSECPETKRKEVKRYQCTFEGCPRTYSTAGNLRTHQKTHRGEYTFVCNQEGCGKAFLTSYSLRIHVRVHTKEKPFECDVQGCEKAFNTLYRLKAHQRLHTGKTFNCESEGCSKYFTTLSDLRKHIRTHTGEKPFRCDHDGCGKAFAASHHLKTHVRTHTGERPFFCPSNGCEKTFSTQYSLKSHMKGHDNKGHSYNALPQHNGSEDTNHSLCLSDLSLLSTDSELRENSSTTQGQDLSTISPAIIFESMFQNSDDTAIQEDPQQTASLTESFNGDAESVSDVPPSTGNSASLSLPLVLQPGLSEPPQPLLPASAPSAPPPAPSLGPGSQQAAFGNPPALLQPPEVPVPHSTQFAANHQEFLPHPQAPQPIVPGLSVVAGASASAAAVASAVAAPAPPQSTTEPLPAMVQTLPLGANSVLTNNPTITITPTPNTAILQSSLVMGEQNLQWILNGATSSPQNQEQIQQASKVEKVFFTTAVPVASSPGSSVQQIGLSVPVIIIKQEEACQCQCACRDSAKERASSRRKGCSSPPPPEPSPQAPDGPSLQLPAQTFSSAPVPGSSSSTLPSSCEQSRQAETPSDPQTETLSAMDVSEFLSLQSLDTPSNLIPIEALLQGEEEMGLTSSFSK

SEQ ID NO: 15316 - protein, 593 aa, Homo Sapiens
MRDSTGAGNSLVHKRSPLRRNQKTPTSLTKLSLQDGHKAKKPACKFEEGQDVLARWSDGLFYLGTIKKINILKQSCFIIFEDSSKSWVLWKDIQTGATGSGEMVCTICQEEYSEAPNEMVICDKCGQGYHQLCHTPHIDSSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQWVDIAHLCLYNLSVIHKKKYFDSELELMTYINENWDRLHPGELADTPKSERYEHVLEALNDYKTMFMSGKEIKKKKHLFGLRIRVPPVPPNVAFKAEKEPEGTSHEFKIKGRKASKPISDSREVSNGIEKKGKKKSVGRPPGPYTRKMIQKTAEPLLDKESISENPTLDLPCSIGRTEGTAHSSNTSDVDFTGASSAKETTSSSISRHYGLSDSRKRTRTGRSWPAAIPHLRRRRGRLPRRALQTQNSEIVKDDEGKEDYQFDELNTEILNNLADQELQLNHLKNSITSYFGAAGRIACGEKYRVLARRVTLDGKVQYLVEWEGATAS

SEQ ID NO: 15317 - protein, 221 aa, Homo Sapiens
MAAAVRMNIQMLLEAADYLERREREAEHGYASMLPYNNKDRDALKRRNKSKKNNSSSRSTHNEMEKNRRAHLRLCLEKLKGLVPLGPESSRHTTLSLLTKAKLHIKKLEDCDRKAVHQIDQLQREQRHLKRQLEKLGIERIRMDSIGSTVSSERSDSDREEIDVDVESTDYLTGDLDWSSSSVSDSDERGSMQSLGSDEGYSSTSIKRIKLQDSHKACLGL

SEQ ID NO: 15318 - protein, 206 aa, Homo Sapiens
MEPLASNIQVLLQAAEFLERREREAEHGYASLCPHRSPGPIHRRKKRPPQAPGAQDSGRSVHNELEKRRRAQLKRCLERLKQQMPLGADCARYTTLSLLRRARMHIQKLEDQEQRARQLKERLRSKQQSLQRQLEQLRGLAGAAERERLRADSLDSSGLSSERSDSDQEELEVDVESLVFGGEAELLRGFVAGQEHSYSHGGGAWL

SEQ ID NO: 15319 - protein, 209 aa, Homo Sapiens
MELNSLLILLEAAEYLERRDREAEHGYASVLPFDGDFAREKTKAAGLVRKAPNNRSSHNELEKHRRAKLRLYLEQLKQLVPLGPDSTRHTTLSLLKRAKVHIKKLEEQDRRALSIKEQLQQEHRFLKRRLEQLSVQSVERVRTDSTGSAVSTDDSEQEVDIEGMEFGPGELDSVGSSSDADDHYSLQSGTGGDSGFGPHCRRLGRPALS

SEQ ID NO: 15320 - protein, 228 aa, Homo Sapiens
MERVKMINVQRLLEAAEFLERRERECEHGYASSFPSMPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 15321 - protein, 640 aa, Homo Sapiens
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 15322 - protein, 752 aa, Homo Sapiens
MAKRSRSEDEDDDLQYADHDYEVPQQKGLKKLWNRVKWTRDEDDKLKKLVEQHGTDDWTLIASHLQNRSDFQCQHRWQKVLNPELIKGPWTKEEDQRVIELVQKYGPKRWSLIAKHLKGRIGKQCRERWHNHLNPEVKKSSWTEEEDRIIYEAHKRLGNRWAEIAKLLPGRTDNSIKNHWNSTMRRKVEQEGYLQDGIKSERSSSKLQHKPCAAMDHMQTQNQFYIPVQIPGYQYVSPEGNCIEHVQPTSAFIQQPFIDEDPDKEKKIKELEMLLMSAENEVRRKRIPSQPGSFSSWSGSFLMDDNMSNTLNSLDEHTSEFYSMDENQPVSAQQNSPTKFLAVEANAVLSSLQTIPEFAETLELIESDPVAWSDVTSFDISDAAASPIKSTPVKLMRIQHNEGAMECQFNVSLVLEGKKNTCNGGNSEAVPLTSPNIAKFSTPPAILRKKRKMRVGHSPGSELRDGSLNDGGNMALKHTPLKTLPFSPSQFFNTCPGNEQLNIENPSFTSTPICGQKALITTPLHKETTPKDQKENVGFRTPTIRRSILGTTPRTPTPFKNALAAQEKKYGPLKIVSQPLAFLEEDIREVLKEETGTDLFLKEEDEPAYKSCKQENTASGKKVRKSLVLDNWEKEESGTQLLTEDISDMQSENRFTTSLLMIPLLEIHDNRCNLIPEKQDINSTNKTYTLTKKKPNPNTSKVVKLEKNLQSNCEWETVVYGKTEDQLIMTEQARRYLSTYTATSSTSRALIL

SEQ ID NO: 15323 - protein, 700 aa, Homo Sapiens
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 15324 - protein, 439 aa, Homo Sapiens
MPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 15325 - protein, 364 aa, Homo Sapiens
MDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSARERLERAVSDRLAPGAPRGNPPKASAAPDCTPSLEAGNPAPAAPCPLGEPKTQACSGSESPSDSENEEIDVVTVEKRQSLGIRKPVTITVRADPLDPCMKHFHISIHQQQHNYAARFPPESCSQEEASERGPQEEVLERDAAGEKEDEEDEEIVSPPPVESEAAQSCHPKPVSSDTEDVTKRKNHNFLERKRRNDLRSRFLALRDQVPTLASCSKAPKVVILSKALEYLQALVGAEKRMATEKRQLRCRQQQLQKRIAYLTGY

SEQ ID NO: 15326 - protein, 358 aa, Homo Sapiens
MDRDSYHHYFYDYDGGEDFYRSTTPSEDIWKKFELVPPPWDLGPAAGNPALSFGLLEPWPVGCAGDETESQDYWKAWDANYASLIRRDCMWSGFSTQEPLERAVSDLLAVGAPSGYSPKEFATPDYTPELEAGNLAPIFPCLLGEPKIQACSRSESPSDSEGEEIDVTVKKRQSLSTRKPVIIAVRADLLDPRMNLFHISIHQQQHNYAAPFPPESCFQEGAPKRMPPKEALEREAPGGKDDKEDEEIVSLPPVESEAAQSCQPKPIHYDTENWTKKKYHSYLERKRRNDQRSRFLALRDEVPALASCSRVSKVMILVKATEYLHELAEAEERMATEKRQLECQRRQLQKRIEYLSSY

SEQ ID NO: 15327 - protein, 464 aa, Homo Sapiens
MPSCSTSTMPGMICKNPDLEFDSLQPCFYPDEDDFYFGGPDSTPPGEDIWKKFELLPTPPLSPSRGFAEHSSEPPSWVTEMLLENELWGSPAEEDAFGLGGLGGLTPNPVILQDCMWSGFSAREKLERAVSEKLQHGRGPPTAGSTAQSPGAGAASPAGRGHGGAAGAGRAGAALPAELAHPAAECVDPAVVFPFPVNKREPAPVPAAPASAPAAGPAVASGAGIAAPAGAPGVAPPRPGGRQTSGGDHKALSTSGEDTLSDSDDEDDEEEDEEEEIDVVTVEKRRSSSNTKAVTTFTITVRPKNAALGPGRAQSSELILKRCLPIHQQHNYAAPSPYVESEDAPPQKKIKSEASPRPLKSVIPPKAKSLSPRNSDSEDSERRRNHNILERQRRNDLRSSFLTLRDHVPELVKNEKAAKVVILKKATEYVHSLQAEEHQLLLEKEKLQARQQQLLKKIEHARTC

SEQ ID NO: 15328 - protein, 255 aa, Homo Sapiens
MDVMDGCQFSPSEYFYDGSCIPSPEGEFGDEFVPRVAAFGAHKAELQGSDEDEHVRAPTGHHQAGHCLMWACKACKRKSTTMDRRKAATMRERRRLKKVNQAFETLKRCTTTNPNQRLPKVEILRNAIRYIESLQELLREQVENYYSLPGQSCSEPTSPTSNCSDGMPECNSPVWSRKSSTFDSIYCPDVSNVYATDKNSLSSLDCLSNIVDRITSSEQPGLPLQDLASLSPVASTDSQPATPGASSSRLIYHVL

SEQ ID NO: 15329 - protein, 242 aa, Homo Sapiens
MMMDLFETGSYFFYLDGENVTLQPLEVAEGSPLYPGSDGTLSPCQDQMPPEAGSDSSGEEHVLAPPGLQPPHCPGQCLIWACKTCKRKSAPTDRRKAATLRERRRLKKINEAFEALKRRTVANPNQRLPKVEILRSAISYIERLQDLLHRLDQQEKMQELGVDPFSYRPKQENLEGADFLRTCSSQWPSVSDHSRGLVITAKEGGASIDSSASSSLRCLSSIVDSISSEERKLPCVEEVVEK

SEQ ID NO: 15330 - protein, 610 aa, Homo Sapiens
MQYSHHCEHLLERLNKQREAGFLCDCTIVIGEFQFKAHRNVLASFSEYFGAIYRSTSENNVFLDQSQVKADGFQKLLEFIYTGTLNLDSWNVKEIHQAADYLKVEEVVTKCKIKMEDFAFIANPSSTEISSITGNIELNQQTCLLTLRDYNNREKSEVSTDLIQANPKQGALAKKSSQTKKKKKAFNSPKTGQNKTVQYPSDILENASVELFLDANKLPTPVVEQVAQINDNSELELTSVVENTFPAQDIVHTVTVKRKRGKSQPNCALKEHSMSNIASVKSPYEAENSGEELDQRYSKAKPMCNTCGKVFSEASSLRRHMRIHKGVKPYVCHLCGKAFTQCNQLKTHVRTHTGEKPYKCELCDKGFAQKCQLVFHSRMHHGEEKPYKCDVCNLQFATSSNLKIHARKHSGEKPYVCDRCGQRFAQASTLTYHVRRHTGEKPYVCDTCGKAFAVSSSLITHSRKHTGEKPYICGICGKSFISSGELNKHFRSHTGERPFICELCGNSYTDIKNLKKHKTKVHSGADKTLDSSAEDHTLSEQDSIQKSPLSETMDVKPSDMTLPLALPLGTEDHHMLLPVTDTQSPTSDTLLRSTVNGYSEPQLIFLQQLY

SEQ ID NO: 15331 - protein, 320 aa, Homo Sapiens
MELLSPPLRDVDLTAPDGSLCSFATTDDFYDDPCFDSPDLRFFEDLDPRLMHVGALLKPEEHSHFPAAVHPAPGAREDEHVRAPSGHHQAGRCLLWACKACKRKTTNADRRKAATMRERRRLSKVNEAFETLKRCTSSNPNQRLPKVEILRNAIRYIEGLQALLRDQDAAPPGAAAAFYAPGPLPPGRGGEHYSGDSDASSPRSNCSDGMMDYSGPPSGARRRNCYEGAYYNEAPSEPRPGKSAAVSSLDCLSSIVERISTESPAAPALLLADVPSESPPRRQEAAAPSEGESSGDPTQSPDAAPQCPAGANPNPIYQVL

SEQ ID NO: 15332 - protein, 224 aa, Homo Sapiens
MELYETSPYFYQEPRFYDGENYLPVHLQGFEPPGYERTELTLSPEAPGPLEDKGLGTPEHCPGQCLPWACKVCKRKSVSVDRRRAATLREKRRLKKVNEAFEALKRSTLLNPNQRLPKVEILRSAIQYIERLQALLSSLNQEERDLRYRGGGGPQPGVPSECSSHSASCSPEWGSALEFSANPGDHLLTADPTDAHNLHSLTSIVDSITVEDVSVAFPDETMPN

SEQ ID NO: 15333 - protein, 1151 aa, Homo Sapiens
MEVVDETEALQRFFEGHDINGALEPSNIDTSILEEYISKEDASDLCFPDISAPASSASYSHGQPAMPGSSGVHHLSPPGGGPSPGRHGPLPPPGYGTPLNCNNNNGMGAAPKPFPGGTGPPIKAEPKAPYAPGTLPDSPPDSGSEAYSPQQVNEPHLLRTITPETLCHVGVPSRLEHPPPPPAHLPGPPPPPPPPPHYPVLQRDLYMKAEPPIPHYAAMGQGLVPTDLHHTQQSQMLHQLLQQHGAELPTHPSKKRKHSESPPSTLNAQMLNGMIKQEPGTVTALPLHPTRAPSPPWPPQGPLSPGPGSLPLSIARVQTPPWHPPGAPSPGLLQDSDSLSGSYLDPNYQSIKWQPHQQNKWATLYDANYKELPMLTYRVDADKGFNFSVGDDAFVCQKKNHFQVTVYIGMLGEPKYVKTPEGLKPLDCFYLKLHGVKLEALNQSINIEQSQSDRSKRPFNPVTVNLPPEQVTKVTVGRLHFSETTANNMRKKGKPNPDQRYFMLVVALQAHAQNQNYTLAAQISERIIVRASNPGQFESDSDVLWQRAQVPDTVFHHGRVGINTDRPDEALVVHGNVKVMGSLMHPSDLRAKEHVQEVDTTEQLKRISRMRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGSFAVSTSCLLALLRPQPPGGSEALCPWSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSASLLAEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 15334 - protein, 828 aa, Homo Sapiens
MAAEEADVDIEGDVVAAAGAQPGSGENTASVLQKDHYLDSSWRTENGLIPWTLDNTISEENRAVIEKMLLEEEYYLSKKSQPEKVWLDQKEDDKKYMKSLQKTAKIMVHSPTKPASYSVKWTIEEKELFEQGLAKFGRRWTKISKLIGSRTVLQVKSYARQYFKNKVKCGLDKETPNQKTGHNLQVKNEDKGTKAWTPSCLRGRADPNLNAVKIEKLSDDEEVDITDEVDELSSQTPQKNSSSDLLLDFPNSKMHETNQGEFITSDSQEALFSKSSRGCLQNEKQDETLSSSEITLWTEKQSNGDKKSIELNDQKFNELIKNCNKHDGRGIIVDARQLPSPEPCEIQKNLNDNEMLFHSCQMVEESHEEEELKPPEQEIEIDRNIIQEEEKQAIPEFFEGRQAKTPERYLKIRNYILDQWEICKPKYLNKTSVRPGLKNCGDVNCIGRIHTYLELIGAINFGCEQAVYNRPQTVDKVRIRDRKDAVEAYQLAQRLQSMRTRRRRVRDPWGNWCDAKDLEGQTFEHLSAEELAKRREEEKGRPVKSLKVPRPTKSSFDPFQLIPCNFFSEEKQEPFQVKVASEALLIMDLHAHVSMAEVIGLLGGRYSEVDKVVEVCAAEPCNSLSTGLQCEMDPVSQTQASETLAVRGFSVIGWYHSHPAFDPNPSLRDIDTQAKYQSYFSRGGAKFIGMIVSPYNRNNPLPYSQITCLVISEEISPDGSYRLPYKFEVQQMLEEPQWGLVFEKTRWIIEKYRLSHSSVPMDKIFRRDSDLTCLQKLLECMRKTLSKVTNCFMAEEFLTEIENLFLSNYKSNQENGVTEENCTKELLM

SEQ ID NO: 15335 - protein, 1121 aa, Homo Sapiens
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEGRSPVKSHFGSNPIGSATASSKGSYSSYQGIIATSLLNLGQIAEETLVEEDLGQAAKPGPGIVHLLQEAAEGAASEEGEKGLFIQPEDAEEVVEVTTERSQDLCPQSLEDAASEESSKQKGILSHEEEDEEEEEEEEEEEEDEEEEEEEEEEEEEEEEEEEEEEEEEEEEEEEEAAPDVIFQEDTSHTSAQKAPELRGPESPSPKPEYSVIVEVRSDDDKDEDTHSRKSTVTDESEMQDMMTRGNLGLLEQAIALKAEQVRTVCEPGCPPAEQSQLGLGEPGKAAKPLDTVRKSYYSKDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQCFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRSLSGCPLADKSLRNLMAAHSADLKCPTPGCDGSGHITGNYASHRSLSGCPRAKKSGVKVAPTKDDKEDPELMKCPVPGCVGLGHISGKYASHRSASGCPLAARRQKEGSLNGSSFSWKSLKNEGPTCPTPGCDGSGHANGSFLTHRSLSGCPRATFAGKKGKLSGDEVLSPKFKTSDVLENDEEIKQLNQEIRDLNESNSEMEAAMVQLQSQISSMEKNLKNIEEENKLIEEQNEALFLELSGLSQALIQSLANIRLPHMEPICEQNFDAYVSTLTDMYSNQDPENKDLLESIKQAVRGIQV

SEQ ID NO: 15336 - protein, 499 aa, Homo Sapiens
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 15337 - protein, 1186 aa, Homo Sapiens
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEGEEYSEDNDEPGDEDEEDEEGDREEEEEIEEEDEDDDEDGEDVEDEEEEEEEEEEEEEEEENEDHQMNCHNTRIMQDTEKDDNNNDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYGKDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKVQTRDISPKGYDDAKRYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELKCPTPGCDGSGHITGNYASHRSLSGCPRAKKSGIRIAQSKEDKEDQEPIRCPVPGCDGQGHITGKYASHRSASGCPLAAKRQKDGYLNGSQFSWKSVKTEGMSCPTPGCDGSGHVSGSFLTHRSLSGCPRATSAMKKAKLSGEQMLTIKQRASNGIENDEEIKQLDEEIKELNESNSQMEADMIKLRTQITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 15338 - protein, 734 aa, Homo Sapiens
MRPAVLGSPDRAPPEDEGPVMVKLEDSEEEGEAALWDPGPEAARLRFRCFRYEEATGPQEALAQLRELCRQWLRPEVRSKEQMLELLVLEQFLGALPPEIQARVQGQRPGSPEEAAALVDGLRREPGGPRRWVTVQVQGQEVLSEKMEPSSFQPLPETEPPTPEPGPKTPPRTMQESPLGLQVKEESEVTEDSDFLESGPLAATQESVPTLLPEEAQRCGTVLDQIFPHSKTGPEGPSWREHPRALWHEEAGGIFSPGFALQLGSISAGPGSVSPHLHVPWDLGMAGLSGQIQSPSREGGFAHALLLPSDLRSEQDPTDEDPCRGVGPALITTRWRSPRGRSRGRPSTGGGVVRGGRCDVCGKVFSQRSNLLRHQKIHTGERPFVCSECGRSFSRSSHLLRHQLTHTEERPFVCGDCGQGFVRSARLEEHRRVHTGEQPFRCAECGQSFRQRSNLLQHQRIHGDPPGPGAKPPAPPGAPEPPGPFPCSECRESFARRAVLLEHQAVHTGDKSFGCVECGERFGRRSVLLQHRRVHSGERPFACAECGQSFRQRSNLTQHRRIHTGERPFACAECGKAFRQRPTLTQHLRVHTGEKPFACPECGQRFSQRLKLTRHQRTHTGEKPYHCGECGLGFTQVSRLTEHQRIHTGERPFACPECGQSFRQHANLTQHRRIHTGERPYACPECGKAFRQRPTLTQHLRTHRREKPFACQDCGRRFHQSTKLIQHQRVHSAE

SEQ ID NO: 15339 - protein, 305 aa, Homo Sapiens
MSVDPACPQSLPCFEASDCKESSPMPVICGPEENYPSLQMSSAEMPHTETVSPLPSSMDLLIQDSPDSSTSPKGKQPTSAEKSVAKKEDKVPVKKQKTRTVFSSTQLCVLNDRFQRQKYLSLQQMQELSNILNLSYKQVKTWFQNQRMKSKRWQKNNWPKNSNGVTQKASAPTYPSLYSSYHQGCLVNPTGNLPMWSNQTWNNSTWSNQTQNIQSWSNHSWNTQTWCTQSWNNQAWNSPFYNCGEESLQSCMQFQPNSPASDLEAALEAAGEGLNVIQQTTRYFSTPQTMDLFLNYSMNMQPEDV

SEQ ID NO: 15340 - protein, 188 aa, Homo Sapiens
MHRARWLTPVIPALWEAEAGRSRGQEIETILANKKQSAMPWDQDPEQSTGNYSEDEQNGKQKWREEGEAGRKREREKEEKNEKELQDEQENKRKRENEKQKQYPEKRLVSKSLMHTLWAKFKLNRCPTIQESLSLSFEFDMTHKQISQWFCKTRKKYNKEMSKRKHKKKHMRWRSLCCQGWSRTPALK

SEQ ID NO: 15341 - protein, 232 aa, Homo Sapiens
MDLPIQDSHDSSTSPKGKQPTTAEKSATKKEDKVPVKKQKTRTVFSSTQLCVLNDRFQRQKYLSLQQMQELSNILNLSYKQVKTWFQNQRMKSKRWQKNNWLKNSNGVTQGCLVNPTGNLPMWSNQTWNNSTWSNQTQNIQSWSNHSWNTQTWCTQSWNNQAWNSPFYNCGEESLQSCMQFQPNSPASDLQAALEAAGEGLNVIQQTTRYFNTPQTMDLFLNYSMNMQPEDV

SEQ ID NO: 15342 - protein, 305 aa, Homo Sapiens
MSVDPACPQSLPCFEESDCKESSPMPVICGPEENYPSLQMSSAEMPHTETVSPLPSSMDLLIQDSPDSSTSPKGKQPTSAENSVAKKEDKVPVKKQKTRTVFSSTQLCVLNDRFQRQKYLSLQQMQELSNILNLSYKQVKTWFQNQRMKSKRWQKNNWPKNSNGVTQKASAPTYPSLYSSYHQGCLVNPTGNLPMWSNQTWNNSTWSNQTQNIQSWSNHSWNTQTWCTQSWNNQAWNSPFYNCGEESLQSCMHFQPNSPASDLEAALEAAGEGLNVIQQTTRYFSTPQTMDLFLNYSMNMQPEDV

SEQ ID NO: 15343 - protein, 1441 aa, Homo Sapiens
MSGLGDSSSDPANPDSHKRKGSPCDTLASSTEKRRREQENKYLEELAELLSANISDIDSLSVKPDKCKILKKTVDQIQLMKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQQVQQVQVFADVQCTVNLVGGDPYLNQPGPLGTQKPTSGPQTPQAQQKSLLQQLLTE

SEQ ID NO: 15344 - protein, 1464 aa, Homo Sapiens
MSGMGENTSDPSRAETRKRKECPDQLGPSPKRNTEKRNREQENKYIEELAELIFANFNDIDNFNFKPDKCAILKETVKQIRQIKEQEKAAAANIDEVQKSDVSSTGQGVIDKDALGPMMLEALDGFFFVVNLEGNVVFVSENVTQYLRYNQEELMNKSVYSILHVGDHTEFVKNLLPKSIVNGGSWSGEPPRRNSHTFNCRMLVKPLPDSEEEGHDNQEAHQKYETMQCFAVSQPKSIKEEGEDLQSCLICVARRVPMKERPVLPSSESFTTRQDLQGKITSLDTSTMRAAMKPGWEDLVRRCIQKFHAQHEGESVSYAKRHHHEVLRQGLAFSQIYRFSLSDGTLVAAQTKSKLIRSQTTNEPQLVISLHMLHREQNVCVMNPDLTGQTMGKPLNPISSNSPAHQALCSGNPGQDMTLSSNINFPINGPKEQMGMPMGRFGGSGGMNHVSGMQATTPQGSNYALKMNSPSQSSPGMNPGQPTSMLSPRHRMSPGVAGSPRIPPSQFSPAGSLHSPVGVCSSTGNSHSYTNSSLNALQALSEGHGVSLGSSLASPDLKMGNLQNSPVNMNPPPLSKMGSLDSKDCFGLYGEPSEGTTGQAESSCHPGEQKETNDPNLPPAVSSERADGQSRLHDSKGQTKLLQLLTTKSDQMEPSPLASSLSDTNKDSTGSLPGSGSTHGTSLKEKHKILHRLLQDSSSPVDLAKLTAEATGKDLSQESSSTAPGSEVTIKQEPVSPKKKENALLRYLLDKDDTKDIGLPEITPKLERLDSKTDPASNTKLIAMKTEKEEMSFEPGDQPGSELDNLEEILDDLQNSQLPQLFPDTRPGAPAGSVDKQAIINDLMQLTAENSPVTPVGAQKTALRISQSTFNNPRPGQLGRLLPNQNLPLDITLQSPTGAGPFPPIRNSSPYSVIPQPGMMGNQGMIGNQGNLGNSSTGMIGNSASRPTMPSGEWAPQSSAVRVTCAATTSAMNRPVQGGMIRNPAASIPMRPSSQPGQRQTLQSQVMNIGPSELEMNMGGPQYSQQQAPPNQTAPWPESILPIDQASFASQNRQPFGSSPDDLLCPHPAAESPSDEGALLDQLYLALRNFDGLEEIDRALGIPELVSQSQAVDPEQFSSQDSNIMLEQKAPVFPQQYASQAQMAQGSYSPMQDPNFHTMGQRPSYATLRMQPRPGLRPTGLVQNQPNQLRLQLQHRLQAQQNRQPLMNQISNVSNVNLTLRPGVPTQAPINAQMLAQRQREILNQHLRQRQMHQQQQVQQRTLMMRGQGLNMTPSMVAPSGMPATMSNPRIPQANAQQFPFPPNYGISQQPDPGFTGATTPQSPLMSPRMAHTQSPMMQQSQANPAYQAPSDINGWAQGNMGGNSMFSQQSPPHFGQQANTSMYSNNMNINVSMATNTGGMSSMNQMTGQISMTSVTSVPTSGLSSMGPEQVNDPALRGGNLFPNQLPGMDMIKQEGDTTRKYC

SEQ ID NO: 15345 - protein, 1424 aa, Homo Sapiens
MSGLGENLDPLASDSRKRKLPCDTPGQGLTCSGEKRRREQESKYIEELAELISANLSDIDNFNVKPDKCAILKETVRQIRQIKEQGKTISNDDDVQKADVSSTGQGVIDKDSLGPLLLQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSGKVVNIDTNSLRSSMRPGFEDIIRRCIQRFFSLNDGQSWSQKRHYQEAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMISPRNRGSPKIASHQFSPVAGVHSPMASSGNTGNHSFSSSSLSALQAISEGVGTSLLSTLSSPGPKLDNSPNMNITQPSKVSNQDSKSPLGFYCDQNPVESSMCQSNSRDHLSDKESKESSVEGAENQRGPLESKGHKKLLQLLTCSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQVFQGTNSLGLKSSQSVQSIRPPYNRAVSLDSPVSVGSSPPVKNISAFPMLPKQPMLGGNPRMMDSQENYGSSMGGPNRNVTVTQTPSSGDWGLPNSKAGRMEPMNSNSMGRPGGDYNTSLPRPALGGSIPTLPLRSNSIPGARPVLQQQQQMLQMRPGEIPMGMGANPYGQAAASNQLGSWPDGMLSMEQVSHGTQNRPLLRNSLDDLVGPPSNLEGQSDERALLDQLHTLLSNTDATGLEEIDRALGIPELVNQGQALEPKQDAFQGQEAAVMMDQKAGLYGQTYPAQGPPMQGGFHLQGQSPSFNSMMNQMNQQGNFPLQGMHPRANIMRPRTNTPKQLRMQLQQRLQGQQFLNQSRQALELKMENPTAGGAAVMRPMMQPQVSSQQGFLNAQMVAQRSRELLSHHFRQQRVAMMMQQQQQQQQQQQQQQQQQQQQQQQQQQQQQTQAFSPPPNVTASPSMDGLLAGPTMPQAPPQQFPYQPNYGMGQQPDPAFGRVSSPPNAMMSSRMGPSQNPMMQHPQAASIYQSSEMKGWPSGNLARNSSFSQQQFAHQGNPAVYSMVHMNGSSGHMGQMNMNPMPMSGMPMGPDQKYC

SEQ ID NO: 15346 - protein, 614 aa, Homo Sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 15347 - protein, 579 aa, Homo Sapiens
MNTAPSRPSPTRRDPYGFGDSRDSRRDRSPIRGSPRREPRDGRNGRDARDSRDIRDPRDLRDHRHSRDLRDHRDSRSVRDVRDVRDLRDFRDLRDSRDFRDQRDPMYDRYRDMRDSRDPMYRREGSYDRYLRMDDYCRRKDDSYFDRYRDSFDGRGPPGPESQSRAKERLKREERRREELYRQYFEEIQRRFDAERPVDCSVIVVNKQTKDYAESVGRKVRDLGMVVDLIFLNTEVSLSQALEDVSRGGSPFAIVITQQHQIHRSCTVNIMFGTPQEHRNMPQADAMVLVARNYERYKNECREKEREEIARQAAKMADEAILQERERGGPEEGVRGGHPPAIQSLINLLADNRYLTAEETDKIINYLRERKERLMRSSTDSLPGPISRQPLGATSGASLKTQPSSQPLQSGQVLPSATPTPSAPPTSQQELQAKILSLFNSGTVTANSSSASPSVAAGNTPNQNFSTAANSQPQQRSQASGNQPPSILGQGGSAQNMGPRPGAPSQGLFGQPSSRLAPASNMTSQRPVSSTGINFDNPSVQKALDTLIQSGPALSHLVSQTTAQMGQPQAPMGSYQRHY

SEQ ID NO: 15348 - protein, 2063 aa, Homo Sapiens
MVLDDLPNLEDIYTSLCSSTMEDSEMDFDSGLEDDDTKSDSILEDSTIFVAFKGNIDDKDFKWKLDAILKNVPNLLHMESSKLKVQKVEPWNSVRVTFNIPREAAERLRILAQSNNQQLRDLGILSVQIEGEGAINLALAQNRSQDVRMNGPMGAGNSVRMEAGFPMASGPGIIRMNNPATVMIPPGGNVSSSMMAPGPNPELQPRTPRPASQSDAMDPLLSGLHIQQQSHPSGSLAPPHHPMQPVSVNRQMNPANFPQLQQQQQQQQQQQQQQQQQQQQQQQQQLQARPPQQHQQQQPQGIRPQFTAPTQVPVPPGWNQLPSGALQPPPAQGSLGTMTANQGWKKAPLPGPMQQQLQARPSLATVQTPSHPPPPYPFGSQQASQAHTNFPQMSNPGQFTAPQMKSLQGGPSRVPTPLQQPHLTNKSPASSPSSFQQGSPASSPTVNQTQQQMGPRPPQNNPLPQGFQQPVSSPGRNPMVQQGNVPPNFMVMQQQPPNQGPQSLHPGLGGMPKRLPPGFSAGQANPNFMQGQVPSTTATTPGNSGAPQLQANQNVQHAGGQGAGPPQNQMQVSHGPPNMMQPSLMGIHGNMNNQQAGTSGVPQVNLSNMQGQPQQGPPSQLMGMHQQIVPSQGQMVQQQGTLNPQNPMILSRAQLMPQGQMMVNPPSQNLGPSPQRMTPPKQMLSQQGPQMMAPHNQMMGPQGQVLLQQNPMIEQIMTNQMQGNKQQFNTQNQSNVMPGPAQIMRGPTPNMQGNMVQFTGQMSGQMLPQQGPVNNSPSQVMGIQGQVLRPPGPSPHMAQQHGDPATTANNDVSLSQMMPDVSIQQTNMVPPHVQAMQGNSASGNHFSGHGMSFNAPFSGAPNGNQMSCGQNPGFPVNKDVTLTSPLLVNLLQSDISAGHFGVNNKQNNTNANKPKKKKPPRKKKNSQQDLNTPDTRPAGLEEADQPPLPGEQGINLDNSGPKLPEFSNRPPGYPSQPVEQRPLQQMPPQLMQHVAPPPQPPQQQPQPQLPQQQQPPPPSQPQSQQQQQQQQQMMMMLMMQQDPKSVRLPVSQNVHPPRGPLNPDSQRMPMQQSGSVPVMVSLQGPASVPPSPDKQRMPMPVNTPLGSNSRKMVYQESPQNPSSSPLAEMASLPEASGSEAPSVPGGPNNMPSHVVLPQNQLMMTGPKPGPSPLSATQGATPQQPPVNSLPSSHGHHFPNVAAPTQTSRPKTPNRASPRPYYPQTPNNRPPSTEPSEISLSPERLNASIAGLFPPQINIPLPPRPNLNRGFDQQGLNPTTLKAIGQAPSNLTMNPSNFATPQTHKLDSVVVNSGKQSNSGATKRASPSNSRRSSPGSSRKTTPSPGRQNSKAPKLTLASQTNAALLQNVELPRNVLVSPTPLANPPVPGSFPNNSGLNPQNSTVSVAAVGGVVEDNKESLNVPQDSDCQNSQSRKEQVNIELKAVPAQEVKMVVPEDQSKKDGQPSDPNKLPSVEENKNLVSPAMREAPTSLSQLLDNSGAPNVTIKPPGLTDLEVTPPVVSGEDLKKASVIPTLQDLSSSKEPSNSLNLPHSNELCSSLVHPELSEVSSNVAPSIPPVMSRPVSSSSISTPLPPNQITVFVTSNPITTSANTSAALPTHLQSALMSTVVTMPNAGSKVMVSEGQSAAQSNARPQFITPVFINSSSIIQVMKGSQPSTIPAAPLTTNSGLMPPSVAVVGPLHIPQNIKFSSAPVPPNALSSSPAPNIQTGRPLVLSSRATPVQLPSPPCTSSPVVPSHPPVQQVKELNPDEASPQVNTSADQNTLPSSQSTTMVSPLLTNSPGSSGNRRSPVSSSKGKGKVDKIGQILLTKACKKVTGSLEKGEEQYGADGETEGQGLDTTAPGLMGTEQLSTELDSKTPTPPAPTLLKMTSSPVGPGTASAGPSLPGGALPTSVRSIVTTLVPSELISAVPTTKSNHGGIASESLAGGLVEEKVGSHPELLPSIAPSQNLVSKETSTTALQASVARPELEVNAAIVSGQSSEPKEIVEKSKIPGRRNSRTEEPTVASESVENGHRKRSSRPASASSSTKDITSAVQSKRRKSK

SEQ ID NO: 15349 - protein, 942 aa, Homo Sapiens
MDTKEEKKERKQSYFARLKKKKQAKQNAETASAVATRTHTGKEDNNTVVLEPDKCNIAVEEEYMTDEKKKRKSNQLKEIRRTELKRYYSIDDNQNKTHDKKEKKMVVQKPHGTMEYTAGNQDTLNSIALKFNITPNKLVELNKLFTHTIVPGQVLFVPDANSPSSTLRLSSSSPGATVSPSSSDAEYDKLPDADLARKALKPIERVLSSTSEEDEPGVVKFLKMNCRYFTDGKGVVGGVMIVTPNNIMFDPHKSDPLVIENGCEEYGLICPMEEVVSIALYNDISHMKIKDALPSDLPQDLCPLYRPGEWEDLASEKDINPFSKFKSINKEKRQQNGEKIMTSDSRPIVPLEKSTGHTPTKPSGSSVSEKLKKLDSSRETSHGSPTVTKLSKEPSDTSSAFESTAKENFLGEDDDFVDLEELSSQTGGGMHKKDTLKECLSLDPEERKKAESQINNSAVEMQVQSALAFLGTENDVELKGALDLETCEKQDIMPEVDKQSGSPESRVENTLNIHEDLDKVKLIEYYLTKNKEGPQVSENLQKTELSDGKSIEPGGIDITLSSSLSQAGDPITEGNKEPDKTWVKKGEPLPVKLNSSTEANVIKEALDSSLESTLDNSCQGAQMDNKSEVQLWLLKRIQVPIEDILPSKEEKSKTPPMFLCIKVGKPMRKSFATHTAAMVQQYGKRRKQPEYWFAVPRERVDHLYTFFVQWSPDVYGKDAKEQGFVVVEKEELNMIDNFFSEPTTKSWEIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFKVFKWSGENSYFINGDISSLELGGGGGRFGLWLDADLYHGRSNSCSTFNNDILSKKEDFIVQDLEVWAFD

SEQ ID NO: 15350 - protein, 2440 aa, Homo Sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 15351 - protein, 2525 aa, Homo Sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNAATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 15352 - protein, 356 aa, Homo Sapiens
MTKSYSESGLMGEPQPQGPPSWTDECLSSQDEEHEADKKEDDLETMNAEEDSLRNGGEEEDEDEDLEEEEEEEEEDDDQKPKRRGPKKKKMTKARLERFKLRRMKANARERNRMHGLNAALDNLRKVVPCYSKTQKLSKIETLRLAKNYIWALSEILRSGKSPDLVSFVQTLCKGLSQPTTNLVAGCLQLNPRTFLPEQNQDMPPHLPTASASFPVHPYSYQSPGLPSPPYGTMDSSHVFHVKPPPHAYSAALEPFFESPLTDCTSPSFDGPLSPPLSINGNFSFKHEPSAEFEKNYAFTMHYPAATLAGAQSHGSIFSGTAAPRCEIPIDNIMSFDSHSHHERVMSAQLNAIFHD

SEQ ID NO: 15353 - protein, 382 aa, Homo Sapiens
MLTRLFSEPGLLSDVPKFASWGDGEDDEPRSDKGDAPPPPPPAPGPGAPGPARAAKPVPLRGEEGTEATLAEVKEEGELGGEEEEEEEEEEGLDEAEGERPKKRGPKKRKMTKARLERSKLRRQKANARERNRMHDLNAALDNLRKVVPCYSKTQKLSKIETLRLAKNYIWALSEILRSGKRPDLVSYVQTLCKGLSQPTTNLVAGCLQLNSRNFLTEQGADGAGRFHGSGGPFAMHPYPYPCSRLAGAQCQAAGGLGGGAAHALRTHGYCAAYETLYAAAGGGGASPDYNSSEYEGPLSPPLCLNGNFSLKQDSSPDHEKSYHYSMHYSALPGSRPTGHGLVFGSSAVRGGVHSENLLSYDMHLHHDRGPMYEELNAFFHN

SEQ ID NO: 15354 - protein, 331 aa, Homo Sapiens
MSKTFVKSKEMGELVNTPSWMDKGLGSQNEVKEEESRPGTYGMLSSLTEEHDSIEEEEEEEEDGEKPKRRGPKKKKMTKARLERFRARRVKANARERTRMHGLNDALDNLRRVMPCYSKTQKLSKIETLRLARNYIWALSEVLETGQTPEGKGFVEMLCKGLSQPTSNLVAGCLQLGPQSVLLEKHEDKSPICDSAISVHNFNYQSPGLPSPPYGHMETHLLHLKPQVFKSLGESSFGSHLPDCSTPPYEGPLTPPLSISGNFSLKQDGSPDLEKSYSFMPHYPSSSLSSGHVHSTPFQAGTPRYDVPIDMSYDSYPHHGIGTQLNTVFTE

SEQ ID NO: 15355 - protein, 337 aa, Homo Sapiens
MLTLPFDESVVMPESQMCRKFSRECEDQKQIKKPESFSKQIVLRGKSIKRAPGEETEKEEEEEDREEEDENGLPRRRGLRKKKTTKLRLERVKFRRQEANARERNRMHGLNDALDNLRKVVPCYSKTQKLSKIETLRLAKNYIWALSEILRIGKRPDLLTFVQNLCKGLSQPTTNLVAGCLQLNARSFLMGQGGEAAHHTRSPYSTFYPPYHSPELTTPPGHGTLDNSKSMKPYNYCSAYESFYESTSPECASPQFEGPLSPPPINYNGIFSLKQEETLDYGKNYNYGMHYCAVPPRGPLGQGAMFRLPTDSHFPYDLHLRSQSLTMQDELNAVFHN

SEQ ID NO: 15356 - protein, 237 aa, Homo Sapiens
MPARLETCISDLDCASSSGSDLSGFLTDEEDCARLQQAASASGPPAPARRGAPNISRASEVPGAQDDEQERRRRRGRTRVRSEALLHSLRRSRRVKANDRERNRMHNLNAALDALRSVLPSFPDDTKLTKIETLRFAYNYIWALAETLRLADQGLPGGGARERLLPPQCVPCLPGPPSPASDAESWGSGAAAASPLSDPSSPAASEDFTYRPGDPVFSFPSLPKDLLHTTPCFIPYH

SEQ ID NO: 15357 - protein, 272 aa, Homo Sapiens
MFVKSETLELKEEEDVLVLLGSASPALAALTPLSSSADEEEEEEPGASGGARRQRGAEAGQGARGGVAAGAEGCRPARLLGLVHDCKRRPSRARAVSRGAKTAETVQRIKKTRRLKANNRERNRMHNLNAALDALREVLPTFPEDAKLTKIETLRFAHNYIWALTETLRLADHCGGGGGGLPGALFSEAVLLSPGGASAALSSSGDSPSPASTWSCTNSPAPSSSVSSNSTSPYSCTLSPASPAGSDMDYWQPPPPDKHRYAPHLPIARDCI

SEQ ID NO: 15358 - protein, 214 aa, Homo Sapiens
MTPQPSGAPTVQVTRETERSFPRASEDEVTCPTSAPPSPTRTRGNCAEAEEGGCRGAPRKLRARRGGRSRPKSELALSKQRRSRRKKANDRERNRMHNLNSALDALRGVLPTFPDDAKLTKIETLRFAHNYIWALTQTLRIADHSLYALEPPAPHCGELGSPGGSPGDWGSLYSPVSQAGSLSPAASLEERPGLLGATFSACLSPGSLAFSDFL

SEQ ID NO: 15359 - protein, 1531 aa, Homo Sapiens
MPSDFISLLSADLDLESPKSLYSRESVYDLLPKELQLPPSRETSVASMSQTSGGEAGSPPPAVVAADASSAPSSSSMGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAAGALNVNVKKEISSPARPCSFEEAMKAMKTTGCNLDKVNIIPNALMTPLIPSSMIKSEDVTPMEVTAEKRSSTIFKTTKSVGSTQQTLENISNIAGNGSFSSPSSSHLPSENEKQQQIQPKAYNPETLTTIQTQDISQPGTFPAVSASSQLPNSDALLQQATQFQTRETQSREILQSDGTVVNLSQLTEASQQQQQSPLQEQAQTLQQQISSNIFPSPNSVSQLQNTIQQLQAGSFTGSTASGSSGSVDLVQQVLEAQQQLSSVLFSAPDGNENVQEQLSADIFQQVSQIQSGVSPGMFSSTEPTVHTRPDNLLPGRAESVHPQSENTLSNQQQQQQQQQQVMESSAAMVMEMQQSICQAAAQIQSELFPSTASANGNLQQSPVYQQTSHMMSALSTNEDMQMQCELFSSPPAVSGNETSTTTTQQVATPGTTMFQTSSSGDGEETGTQAKQIQNSVFQTMVQMQHSGDNQPQVNLFSSTKSMMSVQNSGTQQQGNGLFQQGNEMMSLQSGNFLQQSSHSQAQLFHPQNPIADAQNLSQETQGSLFHSPNPIVHSQTSTTSSEQMQPPMFHSQSTIAVLQGSSVPQDQQSTNIFLSQSPMNNLQTNTVAQEAFFAAPNSISPLQSTSNSEQQAAFQQQAPISHIQTPMLSQEQAQPPQQGLFQPQVALGSLPPNPMPQSQQGTMFQSQHSIVAMQSNSPSQEQQQQQQQQQQQQQQQQQSILFSNQNTMATMASPKQPPPNMIFNPNQNPMANQEQQNQSIFHQQSNMAPMNQEQQPMQFQSQSTVSSLQNPGPTQSESSQTPLFHSSPQIQLVQGSPSSQEQQVTLFLSPASMSALQTSINQQDMQQSPLYSPQNNMPGIQGATSSPQPQATLFHNTAGGTMNQLQNSPGSSQQTSGMFLFGIQNNCSQLLTSGPATLPDQLMAISQPGQPQNEGQPPVTTLLSQQMPENSPLASSINTNQNIEKIDLLVSLQNQGNNLTGSF

SEQ ID NO: 15360 - protein, 943 aa, Homo Sapiens
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQVSAPPSSSCPPGLEHSLCPSSPSPPLPPATQEPTCLQPCSPACPPATGRPQHLPSTVRRDESPTAGPRLLPEVHEDGSPNLAPIPVTVKREPEELDQLYLDDVNEIIRNDLSSTSTHS

SEQ ID NO: 15361 - protein, 925 aa, Homo Sapiens
MNAPERQPQPDGGDAPGHEPGGSPQDELDFSILFDYEYLNPNEEEPNAHKVASPPSGPAYPDDVLDYGLKPYSPLASLSGEPPGRFGEPDRVGPQKFLSAAKPAGASGLSPRIEITPSHELIQAVGPLRMRDAGLLVEQPPLAGVAASPRFTLPVPGFEGYREPLCLSPASSGSSASFISDTFSPYTSPCVSPNNGGPDDLCPQFQNIPAHYSPRTSPIMSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDVNEIIRKEFSGPPARNQT

SEQ ID NO: 15362 - protein, 1075 aa, Homo Sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDVNEIIGRDMSQISVSQGAGVSRQAPLPSPESLDLGRSDGL

SEQ ID NO: 15363 - protein, 902 aa, Homo Sapiens
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 15364 - protein, 373 aa, Homo Sapiens
MSPCPPQQSRNRVIQLSTSELGEMELTWQEIMSITELQGLNAPSEPSFEPQAPAPYLGPPPPTTYCPCSIHPDSGFPLPPPPYELPASTSHVPDPPYSYGNMAIPVSKPLSLSGLLSEPLQDPLALLDIGLPAGPPKPQEDPESDSGLSLNYSDAESLELEGTEAGRRRSEYVEMYPVEYPYSLMPNSLAHSNYTLPAAETPLALEPSSGPVRAKPTARGEAGSRDERRALAMKIPFPTDKIVNLPVDDFNELLARYPLTESQLALVRDIRRRGKNKVAAQNCRKRKLETIVQLERELERLTNERERLLRARGEADRTLEVMRQQLTELYRDIFQHLRDESGNSYSPEEYALQQAADGTIFLVPRGTKMEATD

SEQ ID NO: 15365 - protein, 772 aa, Homo Sapiens; identical to SEQ ID NO: 9337

SEQ ID NO: 15366 - protein, 605 aa, Homo Sapiens
MMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 15367 - protein, 694 aa, Homo Sapiens; identical to SEQ ID NO: 9347

SEQ ID NO: 15368 - protein, 509 aa, Homo Sapiens
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 15369 - protein, 420 aa, Homo Sapiens
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLG

SEQ ID NO: 15370 - protein, 508 aa, Homo Sapiens
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPLNGSGQLKMPSHCLSAQMLAPPPPGLPRLALPPATKPATTSEGGATSPTSPSYSPPDTSPANRSFVGLGPRDPAGIYQAQSWYLG

SEQ ID NO: 15371 - protein, 462 aa, Homo Sapiens
MQLRKMQTVKKEQASLDASSNVDKMMVLNSALTEVSEDSTTGEELLLSEGSVGKNKSSACRRKREFIPDEKKDAMYWEKRRKNNEAAKRSREKRRLNDLVLENKLIALGEENATLKAELLSLKLKFGLISSTAYAQEIQKLSNSTAVYFQDYQTSKSNVSSFVDEHEPSMVSSSCISVIKHSPQSSLSDVSEVSSVEHTQESSVQGSCRSPENKFQIIKQEPMELESYTREPRDDRGSYTASIYQNYMGNSFSGYSHSPPLLQVNRSSSNSPRTSETDDGVVGKSSDGEDEQQVPKGPIHSPVELKHVHATVVKVPEVNSSALPHKLRIKAKAMQIKVEAFDNEFEATQKLSSPIDMTSKRHFELEKHSAPSMVHSSLTPFSVQVTNIQDWSLKSEHWHQKELSGKTQNSFKTGVVEMKDSGYKVSDPENLYLKQGIANLSAEVVSLKRLIATQPISASDSG

SEQ ID NO: 15372 - protein, 502 aa, Homo Sapiens
MYSPYCLTQDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQPNGSGQGKVPGSFLLPPPPPVARPVPLPMPDSKSTSTAPDGAALTPPSPSFATTGASSANRFVSIGPRDGNFLNIPQQSQSWFL

SEQ ID NO: 15373 - protein, 968 aa, Homo Sapiens
MAEDDPYLGRPEQMFHLDPSLTHTIFNPEVFQPQMALPTDGPYLQILEQPKQRGFRFRYVCEGPSHGGLPGASSEKNKKSYPQVKICNYVGPAKVIVQLVTNGKNIHLHAHSLVGKHCEDGICTVTAGPKDMVVGFANLGILHVTKKKVFETLEARMTEACIRGYNPGLLVHPDLAYLQAEGGGDRQLGDREKELIRQAALQQTKEMDLSVVRLMFTAFLPDSTGSFTRRLEPVVSDAIYDSKAPNASNLKIVRMDRTAGCVTGGEEIYLLCDKVQKDDIQIRFYEEEENGGVWEGFGDFSPTDVHRQFAIVFKTPKYKDINITKPASVFVQLRRKSDLETSEPKPFLYYPEIKDKEEVQRKRQKLMPNFSDSFGGGSGAGAGGGGMFGSGGGGGGTGSTGPGYSFPHYGFPTYGGITFHPGTTKSNAGMKHGTMDTESKKDPEGCDKSDDKNTVNLFGKVIETTEQDQEPSEATVGNGEVTLTYATGTKEESAGVQDNLFLEKAMQLAKRHANALFDYAVTGDVKMLLAVQRHLTAVQDENGDSVLHLAIIHLHSQLVRDLLEVTSGLISDDIINMRNDLYQTPLHLAVITKQEDVVEDLLRAGADLSLLDRLGNSVLHLAAKEGHDKVLSILLKHKKAALLLDHPNGDGLNAIHLAMMSNSLPCLLLLVAAGADVNAQEQKSGRTALHLAVEHDNISLAGCLLLEGDAHVDSTTYDGTTPLHIAAGRGSTRLAALLKAAGADPLVENFEPLYDLDDSWENAGEDEGVVPGTTPLDMATSWQVFDILNGKPYEPEFTSDDLLAQGDMKQLAEDVKLQLYKLLEIPDPDKNWATLAQKLGLGILNNAFRLSPAPSKTLMDNYEVSGGTVRELVEALRQMGYTEAIEVIQAASSPVKTTSQAHSLPLSPASTRQQIDELRDSDSVCDSGVETSFRKLSFTESLTSGASLLTLNKMPHDYGQEGPLEGKI

SEQ ID NO: 15374 - protein, 900 aa, Homo Sapiens
MESCYNPGLDGIIEYDDFKLNSSIVEPKEPAPETADGPYLVIVEQPKQRGFRFRYGCEGPSHGGLPGASSEKGRKTYPTVKICNYEGPAKIEVDLVTHSDPPRAHAHSLVGKQCSELGICAVSVGPKDMTAQFNNLGVLHVTKKNMMGTMIQKLQRQRLRSRPQGLTEAEQRELEQEAKELKKVMDLSIVRLRFSAFLRASDGSFSLPLKPVISQPIHDSKSPGASNLKISRMDKTAGSVRGGDEVYLLCDKVQKDDIEVRFYEDDENGWQAFGDFSPTDVHKQYAIVFRTPPYHKMKIERPVTVFLQLKRKRGGDVSDSKQFTYYPLVEDKEEVQRKRRKALPTFSQPFGGGSHMGGGSGGAAGGYGGAGGGGSLGFFPSSLAYSPYQSGAGPMGCYPGGGGGAQMAATVPSRDSGEEAAEPSAPSRTPQCEPQAPEMLQRAREYNARLFGLAQRSARALLDYGVTADARALLAGQRHLLTAQDENGDTPLHLAIIHGQTSVIEQIVYVIHHAQDLGVVNLTNHLHQTPLHLAVITGQTSVVSFLLRVGADPALLDRHGDSAMHLALRAGAGAPELLRALLQSGAPAVPQLLHMPDFEGLYPVHLAVRARSPECLDLLVDSGAEVEATERQGGRTALHLATEMEELGLVTHLVTKLRANVNARTFAGNTPLHLAAGLGYPTLTRLLLKAGADIHAENEEPLCPLPSPPTSDSDSDSEGPEKDTRSSFRGHTPLDLTCSTKVKTLLLNAAQNTMEPPLTPPSPAGPGLSLGDTALQNLEQLLDGPEAQGSWAELAERLGLRSLVDTYRQTTSPSGSLLRSYELAGGDLAGLLEALSDMGLEEGVRLLRGPETRDKLPSTAEVKEDSAYGSQSVEQEAEKLGPPPEPPGGLCHGHPQPQVH

SEQ ID NO: 15375 - protein, 317 aa, Homo Sapiens
MFQAAERPQEWAMEGPRDGLKKERLLDDRHDSGLDSMKDEEYEQMVKELQEIRLEPQEVPRGSEPWKQQLTEDGDSFLHLAIIHEEKALTMEVIRQVKGDLAFLNFQNNLQQTPLHLAVITNQPEIAEALLGAGCDPELRDFRGNTPLHLACEQGCLASVGVLTQSCTTPHLHSILKATNYNGHTCLHLASIHGYLGIVELLVSLGADVNAQEPCNGRTALHLAVDLQNPDLVSLLLKCGADVNRVTYQGYSPYQLTWGRPSTRIQQQLGQLTLENLQMLPESEDEESYDTESEFTEFTEDELPYDDCVFGGQRLTL

SEQ ID NO: 15376 - protein, 356 aa, Homo Sapiens
MAGVACLGKAADADEWCDSGLGSLGPDAAAPGGPGLGAELGPGLSWAPLVFGYVTEDGDTALHLAVIHQHEPFLDFLLGFSAGTEYMDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDSGDEGDEYDDIVVHSSRSQTRLPPTPASKPLPDDPRPV

SEQ ID NO: 15377 - protein, 313 aa, Homo Sapiens
MEAGPWRVSAPPSGPPQFPAVVPGPSLEVARAHMLALGPQQLLAQDEEGDTLLHLFAARGLRWAAYAAAEVLQVYRRLDIREHKGKTPLLVAAAANQPLIVEDLLNLGAEPNAADHQGRSVLHVAATYGLPGVLLAVLNSGVQVDLEARDFEGLTPLHTAILALNVAMRPSDLCPRVLSTQARDRLDCVHMLLQMGANHTSQEIKSNKTVLHLAVQAANPTLVQLLLELPRGDLRTFVNMKAHGNTALHMAAALPPGPAQEAIVRHLLAAGADPTLRNLENEQPVHLLRPGPGPEGLRQLLKRSRVAPPGLSS

SEQ ID NO: 15378 - protein, 500 aa, Homo Sapiens
MNQRRSESRPGNHRLQAYAEPGKGDSGGAGPLSGSARRGRGGGGAIRVRRPCWSGGAGRGGGPAWAVRLPTVTAGWTWPALRTLSSLRAGPSEPHSPGRRPPRAGRPLCQADPQPGKAARRSLEPDPAQTGPRPARAAGMSEARKGPDEAEESQYDSGIESLRSLRSLPESTSAPASGPSDGSPQPCTHPPGPVKEPQEKEDADGERADSTYGSSSLTYTLSLLGGPEAEDPAPRLPLPHVGALSPQQLEALTYISEDGDTLVHLAVIHEAPAVLLCCLALLPQEVLDIQNNLYQTALHLAVHLDQPGAVRALVLKGASRALQDRHGDTALHVACQRQHLACARCLLEGRPEPGRGTSHSLDLQLQNWQGLACLHIATLQKNQPLMELLLRNGADIDVQEGTSGKTALHLAVETQERGLVQFLLQAGAQVDARMLNGCTPLHLAAGRGLMGISSTLCKAGADSLLRNVEDETPQDLTEESLVLLPFDDLKISGKLLLCTD

SEQ ID NO: 15379 - protein, 381 aa, Homo Sapiens
MSNPSPQVPEEEASTSVCRPKSSMASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGELEDEWQEVMGRFEGDASHETQEPESFSAWSDRLAREHAQKCQQQQREAEGSCRPPRAEGSSQSWRQQEEEQRLFRERARAKEEELRESRARRAQEALGDREPKPTRAGPREEHPRGAGRGSLWRFGDVPWPCPGGGDPEAMAAALVARGPPLEEQGALRRYLRVQQVRWHPDRFLQRFRSQIETWELGRVMGAVTALSQALNRHAEALK

SEQ ID NO: 15380 - protein, 718 aa, Homo Sapiens
MIVDKLLDDSRGGEGLRDAAGGCGLMTSPLNLSYFYGASPPAAAPGACDASCSVLGPSAPGSPGSDSSDFSSASSVSSCGAVESRSRGGARAERQPVEPHMGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKCQPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKDRKSGRTALHLAAEEANLELIRLFLELPSCLSFVNAKAYNGNTALHVAASLQYRLTQLDAVRLLMRKGADPSTRNLENEQPVHLVPDGPVGEQIRRILKGKSIQQRAPPY

SEQ ID NO: 15381 - protein, 1299 aa, Homo Sapiens [sequence omitted]

SEQ ID NO: 15382 - protein, 1120 aa, Homo Sapiens
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSEEKCPPCTFLTQKWCMGKHEFRSNIPCHLVDISCGLPCSATLPCGMHKCQRLCHKGECLVDEPCKQPCTTPRADCGHPCMAPCHTSSPCPVTACKAKVELQCECGRRKEMVICSEASSTYQRIAAISMASKITDMQLGGSVEISKLITKKEVHQARLECDEECSALERKKRLAEAFHISEDSDPFNIRSSGSKFSDSLKEDARKDLKFVSDVEKEMETLVEAVNKGKNSKKSHSFPPMNRDHRRIIHDLAQVYGLESVSYDSEPKRNVVVTAIRGKSVCPPTTLTGVLEREMQARPPPPIPHHRHQSDKNPGSSNLQKITKEPIIDYFDVQD

SEQ ID NO: 15383 - protein, 911 aa, Homo Sapiens
MEASWRQVAGGRGRSRGRATAAPSGNGVHLRGAGGGREKGSVGAVPSGTSPGGVATTAAAGSRHSPAGSQALQTTAASELMSQKKFEEIKKANQAAARKLVEEQFSSSSEEGDEDFEGKQGKILANTFITYTTQTDGDTRELERTKQYVNEAFQAGAMTCLICIASVKRNQAVWSCSGCFCIFHMPCIQKWAKDSQFLVSSVTDDDFGKKDCPWPCPKCRFEYKRSETPSRYYCYCGKVEDPPLDPWLVPHSCGQVCEREFKPPCGHKCLLLCHPGPCPPCPKMVTTTCYCKKAKPIPRRCSAKEWSCQLPCGQKLLCGQHKCENPCHAGSCQPCPRVSRQKCVCGKKVAERSCASPLWHCDQVCGKTLPCGNHTCEQVCHVGACGECPRSGKRFCPCQKSKFSLPCTEDVPTCGDSCDKVLECGIHRCSQRCHRGPCETCRQEVEKHCRCGKHTKRMPCHKPYLCETKCVKMRDCQKHQCRRKCCPGNCPPCDQNCGRTLGCRNHKCPSVCHRGSCYPCPETVDVKCNCGNTKVTVPCGRERTTRPPKCKEQCSRPPTCHHTSQEKHRCHFGSCPPCHQPCQKVLEKCGHLCPAPCHDQALIKQTGRHQPTGPWEQPSEPAFIQTALPCPPCQVPIPMECLGKHEVSPLPCHAVGPYSCKRVCGRILDCQNHTCMKECHKVTKTDGCTGKNKAGPECLHCEEGCSKSRPLGCLHPCILRCHPGECPPCVQMLRIKCHCKITSLYVECRKITTADVNEKNLLSCCKNQCPKELPCGHRCKEMCHPGECPFNCNQKVKLRCPCKRIKKELQCNKVRENQVSIECDTTCKEMKRKASEIKEAEAKAALEEEKRRQQAELEAFENRLKGRRKKNRKRDEVAVELSLWQKHKYYLISVCGVVVVVFAWYITHDVN

SEQ ID NO: 15384 - protein, 347 aa, Homo Sapiens
MEQYTANSNSSTEQIVVQAGQIQQQQQGGVTAVQLQTEAQVASASGQQVQTLQVVQGQPLMVQVSGGQLITSTGQPIMVQAVPGGQGQTIMQVPVSGTQGLQQIQLVPPGQIQIQGGQAVQVQGQQGQTQQIIIQQPQTAVTAGQTQTQQQIAVQGQQVAQTAEGQTIVYQPVNADGTILQQVTVPVSGMITIPAASLAGAQIVQTGANTNTTSSGQGTVTVTLPVAGNVVNSGGMVMMVPGAGSVPAIQRIPLPGAEMLEEEPLYVNAKQYHRILKRRQARAKLEAEGKIPKERRKYLHESRHRHAMARKRGEGGRFFSPKEKDSPHMQDPNQADEEAMTQIIRVS

SEQ ID NO: 15385 - protein, 207 aa, Homo Sapiens
MTMDGDSSTTDASQLGISADYIGGSHYVIQPHDDTEDSMNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGAVTATDGLSEELTEEAFTNQLPAGLITTDGQQQNVMVYTTSYQQISGVQQIQFS

SEQ ID NO: 15386 - protein, 458 aa, Homo Sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQGQRNASQGKPRRCLKETLQITQTEVQQGQQQFSQFTDGQRNSVQQARVSELTGEAEPREVKATGNSTPCTSSLPTTHPPSHRAGASCVCCSQPQQSSTSPPPSDALQWVVVEVSGTPNQLETHRELHAPLPGMTSLSPLHPSQQLYQIQQVTMPAGQDLAQPMFIQSANQPSDGQAPQVTGD

SEQ ID NO: 15387 - protein, 133 aa, Homo Sapiens
MMLNSDTMELDLPPTHSETESGFSDCGGGAGPDGAGPGGPGGGQARGPEPGEPGRKDLQHLSREERRRRRRATAKYRTAHATRERIRVEAFNLAFAELRKLLPTLPPDKKLSKIEILRLAICYISYLNHVLDV

SEQ ID NO: 15388 - protein, 135 aa, Homo Sapiens
MMLSPDQAADSDHPSSAHSDPESLGGTDTKVLGSVSDLEPVEEAEGDGKGGSRAALYPHPQQLSREEKRRRRRATAKYRSAHATRERIRVEAFNLAFAELRKLLPTLPPDKKLSKIEILRLAICYISYLNHVLDV

SEQ ID NO: 15389 - protein, 690 aa, Homo Sapiens
MEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGFILTKDQPVTANMYFDSGNPAPSTTSQQANSQSTPEPSPSQTFPESVVAEKQYFIEKLTATIWKNLSNPEMTSGSDKINYTYMLTRCIQACKTNPEYIYAPLKEIPPADIPKNKKLLTDGYACEVRCQNIYLTTGYAGSKNGSRDRATELAVKLLQKRIEVRVVRRKFKHTFGEDLVVCQIGMSSYEFPPALKPPEDLVVLGKDASGQPIFNASAKHWTNFVITENANDAIGILNNSASFNKMSIEYKYEMMPNRTWRCRVFLQDHCLAEGYGTKKTSKHAAADEALKILQKTQPTYPSVKSSQCHTGSSPRGSGKKKDIKDLVVYENSSNPVCTLNDTAQFNRMTVEYVYERMTGLRWKCKVILESEVIAEAVGVKKTVKYEAAGEAVKTLKKTQPTVINNLKKGAVEDVISRNEIQGRSAEEAYKQQIKEDNIGNQLLRKMGWTGGGLGKSGEGIREPISVKEQHKREGLGLDVERVNKIAKRDIEQIIRNYARSESHTDLTFSRELTNDERKQIHQIAQKYGLKSKSHGVGHDRYLVVGRKRRKEDLLDQLKQEGQVGHYELVMPQAN

SEQ ID NO: 15390 - protein, 411 aa, Homo Sapiens
MDGRAELPAFPRAGAPPLAASDTVPAAPEGAGAARPAAPLRPTSFSVLDILDPNKFNSRRRRCVLLGPVAPAACAPCASAPCAPAPAASGRPPRAEELERRALAGAGGVGAAGAEPPNAGDPFKAGEAETNDTNGYSSGGGGHSPSADSGDEVPDDEDDDEDEAPETEAARGAEEARGGGGGLGARGSGCQGAAETDASPGATVDEAAAPGPRENSPVAQGPPGGAAAPGGAGTTPQGTATAAKPKRKRTGSDSKSGKPRRARTAFTYEQLVALENKFKATRYLSVCERLNLALSLSLTETQVKIWFQNRRTKWKKQNPGADTSAPTGGGGGPGPGAGPGTGLPGGLSPLSPSPPMGAPLGMHGPAGYPAHGPGGLVCAAQLPFLSSPAVLSPFVLGSQTYGAPAFYAPHL

SEQ ID NO: 15391 - protein, 310 aa, Homo Sapiens
MLAWQDGGAKAAPSHHKISFSVLDILDPQKFTRAALPAVRPAPREARKSLAEVEAGKDASSRDPVRQLETPDAAGPGAGQASPLEGSEAEEEEDAEDPRRPRLRERAARLLPGLARSPDAPAGALASGEPCEDGGGGPVRSPPGSPGSPRPRRRRLEPNCAKPRRARTAFTYEQLVALENKFRATRYLSVCERLNLALSLSLTETQVKIWFQNRRTKWKKQNPGADGAAQVGGGAPQPGAAGGGGGGGSGGSPGPPGTGALHFQTFPSYSAANVLFPSAASFPLTAAAPGSPFAPFLGPSYLTPFYAPRL

SEQ ID NO: 15392 - protein, 371 aa, Homo Sapiens
MSMSPKHTTPFSVSDILSPLEESYKKVGMEGGGLGAPLAAYRQGQAAPPTAAMQQHAVGHHGAVTAAYHMTAAGVPQLSHSAVGGYCNGNLGNMSELPPYQDTMRNSASGPGWYGANPDPRFPAISRFMGPASGMNMSGMGGLGSLGDVSKNMAPLPSAPRRKRRVLFSQAQVYELERRFKQQKYLSAPEREHLASMIHLTPTQVKIWFQNHRYKMKRQAKDKAAQQQLQQDSGGGGGGGGTGCPQQQQAQQQSPRRVAVPVLVKDGKPCQAGAPAPGAASLQGHAQQQAQHQAQAAQAAAAAISVGSGGAGLGAHPGHQPGSAGQSPDLAHHAASPAALQGQVSSLSHLNSSGSDYGTMSCSTLLYGRTW

SEQ ID NO: 15393 - protein, 273 aa, Homo Sapiens
MSLTNTKTGFSVKDILDLPDTNDEEGSVAEGPEEENEGPEPAKRAGPLGQGALDAVQSLPLKNPFYDSSDNPYTRWLASTEGLQYSLHGLAAGAPPQDSSSKSPEPSADESPDNDKETPGGGGDAGKKRKRRVLFSKAQTYELERRFRQQRYLSAPEREHLASLIRLTPTQVKIWFQNHRYKMKRARAEKGMEVTPLPSPRRVAVPVLVRDGKPCHALKAQDLAAATFQAGIPFSAYSAQSLQHMQYNAQYSSASTPQYPTAHPLVQAQQWTW

SEQ ID NO: 15394 - protein, 364 aa, Homo Sapiens
MMLPSPVTSTPFSVKDILNLEQQHQHFHGAHLQADLEHHFHSAPCMLAAAEGTQFSDGGEEDEEDEGEKLSYLNSLAAADGHGDSGLCPQGYVHTVLRDSCSEPKEHEEEPEVVRDRSQKSCQLKKSLETAGDCKAAEESERPKPRSRRKPRVLFSQAQVFELERRFKQQRYLSAPEREHLASSLKLTSTQVKIWFQNRRYKCKRQRQDKSLELGAHAPPPPPRRVAVPVLVRDGKPCVTPSAQAYGAPYSVGASAYSYNSFPAYGYGNSAAAAAAAAAAAAAAAAYSSSYGCAYPAGGGGGGGGTSAATTAMQPACSAAGGGPFVNVSNLGGFGSGGSAQPLHQGTAAGAACAQGTLQGIRAW

SEQ ID NO: 15395 - protein, 354 aa, Homo Sapiens
MSLSPKHTTPFSVSDILSPIEETYKKFSGAMDGAPPGLGAPLGAAAAYRAPPPGPSSQAATVAGMQPSHAMAGHNAAAAAAAAAAAAAAAATYHMPPGVSQFPHGAMGSYCNGGLGNMGELPAYTDGMRGGAATGWYGANPDPRYSSISRFMGPSAGVNVAGMGSLTGIADAAKSLGPLHAAAAAAAPRRKRRVLFSQAQVYELERRFKQQKYLSAPEREHLASMIHLTPTQVKIWFQNHRYKMKRQAKDKAAQQLQQEGGLGPPPPPPPSPRRVAVPVLVKDGKPCQNGASTPTPGQAGPQPPAPTPAPELEELSPSPPALHGPGGGLAALDAAAGEYSGGVLGANLLYGRTW

SEQ ID NO: 15396 - protein, 324 aa, Homo Sapiens
MFPSPALTPTPFSVKDILNLEQQQRSLAAAGELSARLEATLAPSSCMLAAFKPEAYAGPEAAAPGLPELRAELGRAPSPAKCASAFPAAPAFYPRAYSDPDPAKDPRAEKKELCALQKAVELEKTEADNAERPRARRRRKPRVLFSQAQVYELERRFKQQRYLSAPERDQLASVLKLTSTQVKIWFQNRRYKCKRQRQDQTLELVGLPPPPPPPARRIAVPVLVRDGKPCLGDSAPYAPAYGVGLNPYGYNAYPAYPGYGGAACSPGYSCTAAYPAGPSPAQPATAAANNNFVNFGVGDLNAVQSPGIPQSNSGVSTLHGIRAW

SEQ ID NO: 15397 - protein, 301 aa, Homo Sapiens
MLLSPVTSTPFSVKDILRLERERSCPAASPHPRVRKSPENFQYLRMDAEPRGSEVHNAGGGGGDRKLDGSEPPGGPCEAVLEMDAERMGEPQPGLNAASPLGGGTRVPERGVGNSGDSVRGGRSEQPKARQRRKPRVLFSQAQVLALERRFKQQRYLSAPEREHLASALQLTSTQVKIWFQNRRYKCKRQRQDKSLELAGHPLTPRRVAVPVLVRDGKPCLGPGPGAPAFPSPYSAAVSPYSCYGGYSGAPYGAGYGTCYAGAPSGPAPHTPLASAGFGHGGQNATPQGHLAATLQGVRAW

SEQ ID NO: 15398 - protein, 239 aa, Homo Sapiens
MATSGRLSFTVRSLLDLPEQDAQHLPRREPEPRAPQPDPCAAWLDSERGHYPSSDESSLETSPPDSSQRPSARPASPGSDAEKRKKRRVLFSKAQTLELERRFRQQRYLSAPEREQLASLLRLTPTQVKIWFQNHRYKLKRARAPGAAESPDLAASAELHAAPGLLRRVVVPVLVRDGQPCGGGGGGEVGTAAAQEKCGAPPAAACPLPGYPAFGPGSALGLFPAYQHLASPALVSWNW

SEQ ID NO: 15399 - protein, 234 aa, Homo Sapiens
MLRVPEPRPGEAKAEGAAPPTPSKPLTSFLIQDILRDGAQRQGGRTSSQRQRDPEPEPEPEPEGGRSRAGAQNDQLSTGPRAAPEEAETLAETEPERHLGSYLLDSENTSGALPRLPQTPKQPQKRSRAAFSHTQVIELERKFSHQKYLSAPERAHLAKNLKLTETQVKIWFQNRRYKTKRKQLSSELGDLEKHSSLPALKEEAFSRASLVSVYNSYPYYPYLYCVGSWSPAFW

SEQ ID NO: 15400 - protein, 333 aa, Homo Sapiens
MAVRGANTLTSFSIQAILNKKEERGGLAAPEGRPAPGGTAASVAAAPAVCCWRLFGERDAGALGGAEDSLLASPAGTRTAAGRTAESPEGWDSDSALSEENESRRRCADARGASGAGLAGGSLSLGQPVCELAASKDLEEEAAGRSDSEMSASVSGDRSPRTEDDGVGPRGAHVSALCSGAGGGGGSGPAGVAEEEEEPAAPKPRKKRSRAAFSHAQVFELERRFNHQRYLSGPERADLAASLKLTETQVKIWFQNRRYKTKRRQMAADLLASAPAAKKVAVKVLVRDDQRQYLPGEVLRPPSLLPLQPSYYYPYYCLPGWALSTCAAAAGTQ

SEQ ID NO: 15401 - protein, 367 aa, Homo Sapiens
MLAVGAMEGTRQSAFLLSSPPLAALHSMAEMKTPLYPAAYPPLPAGPPSSSSSSSSSSSPSPPLGTHNPGGLKPPATGGLSSLGSPPQQLSAATPHGINDILSRPSMPVASGAALPSASPSGSSSSSSSSASASSASAAAAAAAAAAAAASSPAGLLAGLPRFSSLSPPPPPPGLYFSPSAAAVAAVGRYPKPLAELPGRTPIFWPGVMQSPPWRDARLACTPHQGSILLDKDGKRKHTRPTFSGQQIFALEKTFEQTKYLAGPERARLAYSLGMTESQVKVWFQNRRTKWRKKHAAEMATAKKKQDSETERLKGASENEEEDDDYNKPLDPNSDDEKITQLLKKHKSSSGGGGGLLLHASEPESSS

SEQ ID NO: 15402 - protein, 277 aa, Homo Sapiens
MDTNRPGAFVLSSAPLAALHNMAEMKTSLFPYALQGPAGFKAPALGGLGAQLPLGTPHGISDILGRPVGAAGGGLLGGLPRLNGLASSAGVYFGPAAAVARGYPKPLAELPGRPPIFWPGVVQGAPWRDPRLAGPAPAGGVLDKDGKKKHSRPTFSGQQIFALEKTFEQTKYLAGPERARLAYSLGMTESQVKVWFQNRRTKWRKRHAVEMASAKKKQDSDAEKLKVGGSDAEDDDEYNRPLDPNSDDEKITRLLKKHKPSNLALVSPCGGGAGDAL

SEQ ID NO: 15403 - protein, 265 aa, Homo Sapiens
MESNLQGTFLLNNTPLAQFPEMKAPVCQYSVQNSFYKLSPPGLGPQLAAGTPHGITDILSRPVAAPNNSLLSGYPHVAGFGGLSSQGVYYSPQVGNFSKAGNEYPTRTRNCWADTGQDWRGGRQCSNTPDPLSDSIHKKKHTRPTFTGHQIFALEKTFEQTKYLAGPERARLAYSLGMTESQVKVWFQNRRTKWRKKSALEPSSSTPRAPGGAGAGAGGDRAPSENEDDEYNKPLDPDSDDEKIRLLLRKHRAAFSVLSLGAHSV

SEQ ID NO: 15404 - protein, 691 aa, Homo Sapiens
MALLLTLTSPDLEGTWDTRDKDGFKAQEGPPLAVPEFPVCGLYRIYGVCGSFSSFFIIRCSLCALETLKSPQHDPLEIPEQSLKLIPLVSGKRELTRGQKAGEKPLAAGPGEEELLRGSAPHAQDTQSEELPPSCTISGEKKPPAVSGEATGADAGRLCPPPRSRAPHKDRTLARSRPQTQGEDCSLPVGEVKIGKRSYSPAPGKQKKPNAMGLAPTSSPGAPNSARATHNPVPCGSGRGPCHLANLLSTLAQSNQNRDHKQGPPEVTCQIRKKTRTLYRSDQLEELEKIFQEDHYPDSDKRREIAQTVGVTPQRIMVKGAGSLVAGWSGGGPTIETLELQSERSAVAWVWFQNRRAKWRKMEKLNGKESKDNPAAPGPASSQCSSAAEILPAVPMEPKPDPFPQESPLDTFPEPPMLLTSDQTLAPTQPSEGAQRVVTPPLFSPPPVRRADLPFPLGPVHTPQLMPLLMDVAGSDSSHKDGPCGSWGTSITLPPPCSYLEELEPQDYQQSNQPGPFQFSQAPQPPLFQSPQPKLPYLPTFPFSMPSSLTLPPPEDSLFMFPCGPSGGTSQGYCPGASSGQILMQPPAGNIGTASWSDPCLPELPFPGPFCPQALGHPPGGDGYFPDLFPTPCPQALGRQPSSALSWMPEGARPGTGPLLSKAKEEPPAASLDQPSALEEARGDDKNSHVP

SEQ ID NO: 15405 - protein, 800 aa, Homo Sapiens
MKARRNKKQIPSFRKLIKTSKVKLENKLKNKQFKQQSTLKKYRKEQRKLRQAVKDAVSKKPIPLENPKEKRPGKRIEREEEEEEEALPLDMMDEDDLQLMKDLGQRVSFLTRDLSSSEPVHAKKRKHERIIDKYEKIPRTLQTAPEKELIHLLPIKDKSGIIPQTREKPVTDSNKDEEDQEEERELEEEIIEDPIQELTIEEHLIERKKKLQEKKMHIAALASAILSDPENNIKKLKELRSMLMEQDPDVAVTVRKLVIVSLMELFKDITPSYKIRPLTEAEKSTKTRKETQKLREFEEGLVSQYKFYLENLEQMVKDWKQRKLKKSNVVSLKAYKGLAEVAVKSLCELLVALPHFNFHNNIIVLIVPLMNDMSKLISEMCCEAVKKLFKQDKLGQASLGVIKVISGFVKGRNYEVRPEMLKTFLCLRIKEVEVKKDTEDINKPKKFMTFKEKRKSLSRMQRKWKKAEEKLERELREAEASESTEKKLKLHTETLNIVFVTYFRILKKAQRSPLLPAVLEGLAKFAHLINVEFFDDLLVVLHTLIESGDLSYQESLHCVQTAFHILSGQGDVLNIDPLKFYTHLYKTLFKLHAGATNEGVEIVLQCLDVMLTKRRKQVSQQRALAFIKRLCTLALHVLPNSSIGILATTRILMHTFPKTDLLLDSESQGSGVFLPELDEPEYCNAQNTALWELHALRRHYHPIVQRFAAHLIAGAPSEGSGALKPELSRRSATELFEAYSMAEMTFNPPVESSNPKIKGKFLQGDSFLNEDLNQLIKRYSSEVATESPLDFTKYLKTSLH

SEQ ID NO: 15406 - protein, 516 aa, Homo Sapiens
MEREPGAAGVRRALGRRLEAVLASRSEANAVFDILAVLQSEDQEEIQEAVRTCSRLFGALLERGELFVGQLPSEEMVMTGSQGATRKYKVWMRHRYHSCCNRLGELLGHPSFQVKELALSALLKFVQLEGAHPLEKSKWEGNYLFPRELFKLVVGGLLSPEEDQSLLLSQFREYLDYDDTRYHTMQAAVDAVARVTGQHPEVPPAFWNNAFTLLSAVSLPRREPTVSSFYVKRAELWDTWKVAHLKEHRRVFQAMWLSFLKHKLPLSLYKKVLLIVHDAILPQLAQPTLMIDFLTRACDLGGALSLLALNGLFILIHKHNLEYPDFYRKLYGLLDPSVFHVKYRARFFHLADLFLSSSHLPAYLVAAFAKRLARLALTAPPEALLMVLPFICNLLRRHPACRVLVHRPHGPELDADPYDPGEEDPAQSRALESSLWELQALQRHYHPEVSKAASVINQALSMPEVSIAPLLELTAYEIFERDLKKKGPEPVPLEFIPAQGLLGRPGELCAQHFTLS

SEQ ID NO: 15407 - protein, 471 aa, Homo Sapiens
MQSNKTFNLEKQNHTPRKHHQHHHQQQHHQQQQQQPPPPPIPANGQQASSQNEGLTIDLKNFRKPGEKTFTQRSRLFVGNLPPDITEEEMRKLFEKYGKAGEVFIHKDKGFGFIRLETRTLAEIAKVELDNMPLRGKQLRVRFACHSASLTVRNLPQYVSNELLEEAFSVFGQVERAVVIVDDRGRPSGKGIVEFSGKPAARKALDRCSEGSFLLTTFPRPVTVEPMDQLDDEEGLPEKLVIKNQQFHKEREQPPRFAQPGSFEYEYAMRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 15408 - protein, 251 aa, Homo Sapiens
MPSPRPRGSPPPAPSGSRVRPPRSGRSPAPRSPTGPNTPRAPGRFESPFSVEAILARPDPCAPAASQPSGSACVHPAFWTAASLCATGGLPWACPTSWLPAYLSVGFYPVPGPRVAPVCGLLGFGVTGLELAHCSGLWAFPDWAPTEDLQDTERQQKRVRTMFNLEQLEELEKVFAKQHNLVGKKRAQLAARLKLTENQVRVWFQNRRVKYQKQQKLRAAVTSAEAASLDEPSSSSIASIQSDDAESGVDG

SEQ ID NO: 15409 - protein, 590 aa, Homo Sapiens
MAAPYPGSGGGSEVKCVGGRGASVPWDFLPGLMVKAPSGPCLQAQRKEKSRNAARSRRGKENLEFFELAKLLPLPGAISSQLDKASIVRLSVTYLRLRRFAALGAPPWGLRAAGPPAGLAPGRRGPAALVSEVFEQHLGGHILQSLDGFVFALNQEGKFLYISETVSIYLGLSQVEMTGSSVFDYIHPGDHSEVLEQLGLRTPTPGPPTPPSVSSSSSSSSSLADTPEIEASLTKVPPSSLVQERSFFVRMKSTLTKRGLHVKASGYKVIHVTGRLRAHALGLVALGHTLPPAPLAELPLHGHMIVFRLSLGLTILACESRVSDHMDLGPSELVGRSCYQFVHGQDATRIRQSHVDLLDKGQVMTGYYRWLQRAGGFVWLQSVATVAGSGKSPGEHHVLWVSHVLSQAEGGQTPLDAFQLPASVACEEASSPGPEPTEPEPPTEGKQAAPAENEAPQTQGKRIKVEPGPRETKGSEDSGDEDPSSHPATPRPEFTSVIRAGVLKQDPVRPWGLAPPGDPPPTLLHAGFLPPVVRGLCTPGTIRYGPAELGLVYPHLQRLGPGPALPEAFYPPLGLPYPGPAGTRLPRKGD

SEQ ID NO: 15410 - protein, 824 aa, Homo Sapiens
MDEDEKDRAKRASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVYKILSSHMLVTDSPSPEYLKSDSDLEFYCHLLRGSLNPKEFPTYEYIKFVGNFRSYNNVPSPSCNGFDNTLSRPCRVPLGKEVCFIATVRLATPQFLKEMCIVDEPLEEFTSRHSLEWKFLFLDHRAPPIIGYLPFEVLGTSGYDYYHIDDLELLARCHQHLMQFGKGKSCCYRFLTKGQQWIWLQTHYYITYHQWNSKPEFIVCTHSVVSYADVRVERRQELALEDPPSEALHSSALKDKGSSLEPRQHFNTLDVGASGLNTSHSPSASSRSSHKSSHTAMSEPTSTPTKLMAEASTPALPRSATLPQELPVPGLSQAATMPAPLPSPSSCDLTQQLLPQTVLQSTPAPMAQFSAQFSMFQTIKDQLEQRTRILQANIRWQQEELHKIQEQLCLVQDSNVQMFLQQPAVSLSFSSTQRPEAQQQLQQRSAAVTQPQLGAGPQLPGQISSAQVTSQHLLRESSVISTQGPKPMRSSQLMQSSGRSGSSLVSPFSSATAALPPSLNLTTPASTSQDASQCQPSPDFSHDRQLRLLLSQPIQPMMPGSCDARQPSEVSRTGRQVKYAQSQTVFQNPDAHPANSSSAPMPVLLMGQAVLHPSFPASQPSPLQPAQARQQPPQHYLQVQAPTSLHSEQQDSLLLSTYSQQPGTLGYPQPPPAQPQPLRPPRRVSSLSESSGLQQPPR

SEQ ID NO: 15411 - protein, 933 aa, Homo Sapiens
MAPTKPSFQQDPSRRERITAQHPLPNQSECRKIYRYDGIYCESTYQNLQALRKEKSRDAARSRRGKENFEFYELAKLLPLPAAITSQLDKASIIRLTISYLKMRDFANQGDPPWNLRMEGPPPNTSVKVIGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 15412 - protein, 802 aa, Homo Sapiens
MYRSTKGASKARRDQINAEIRNLKELLPLAEADKVRLSYLHIMSLACIYTRKGVFFAGGTPLAGPTGLLSAQELEDIVAALPGFLLVFTAEGKLLYLSESVSEHLGHSMVDLVAQGDSIYDIIDPADHLTVRQQLTLPSALDTDRLFRCRFNTSKSLRRQSAGNKLVLIRGRFHAHPPGAYWAGNPVFTAFCAPLEPRPRPGPGPGPGPASLFLAMFQSRHAKDLALLDISESVLIYLGFERSELLCKSWYGLLHPEDLAHASAQHYRLLAESGDIQAEMVVRLQAKTGGWAWIYCLLYSEGPEGPITANNYPISDMEAWSLRQQLNSEDTQAAYVLGTPTMLPSFPENILSQEECSSTNPLFTAALGAPRSTSFPSAPELSVVSASEELPRPSKELDFSYLTFPSGPEPSLQAELSKDLVCTPPYTPHQPGGCAFLFSLHEPFQTHLPTPSSTLQEQLTPSTATFSDQLTPSSATFPDPLTSPLQGQLTETSVRSYEDQLTPCTSTFPDQLLPSTATFPEPLGSPAHEQLTPPSTAFQAHLDSPSQTFPEQLSPNPTKTYFAQEGCSFLYEKLPPSPSSPGNGDCTLLALAQLRGPLSVDVPLVPEGLLTPEASPVKQSFFHYSEKEQNEIDRLIQQISQLAQGMDRPFSAEAGTGGLEPLGGLEPLDSNLSLSGAGPPVLSLDLKPWKCQELDFLADPDNMFLEETPVEDIFMDLSTPDPSEEWGSGDPEAEGPGGAPSPCNNLSPEDHSFLEDLATYETAFETGVSAFPYDGFTDELHQLQSQVQDSFHEDGSGGEPTF

SEQ ID NO: 15413 - protein, 470 aa, Homo Sapiens
MAGENHQWQGSILYNMLMSAKQTRAAPEAPETRLVDQCWGCSCGDEPGVGREGLLGGRNVALLYRCCFCGKDHPRQGSILYSMLTSAKQTYAAPKAPEATLGPCWGCSCGSDPGVGRAGLPGGRPVALLYRCCFCGEDHPRQGSILYSLLTSSKQTHVAPAAPEARPGGAWWDRSYFAQRPGGKEALPGGRATALLYRCCFCGEDHPQQGSTLYCVPTSTNQAQAAPEERPRAPWWDTSSGALRPVALKSPQVVCEAASAGLLKTLRFVKYLPCFQVLPLDQQLVLVRNCWASLLMLELAQDRLQFETVEVSEPSMLQKILTTRRRETGGNEPLPVPTLQHHLAPPAEARKVPSASQVQAIKCFLSKCWSLNISTKEYAYLKGTVLFNPDVPGLQCVKYIQGLQWGTQQILSEHTRMTHQGPHDRFIELNSTLFLLRFINANVIAELFFRPIIGTVSMDDMMLEMLCTKI

SEQ ID NO: 15414 - protein, 257 aa, Homo Sapiens
MSTSQPGACPCQGAASRPAILYALLSSSLKAVPRPRSRCLCRQHRPVQLCAPHRTCREALDVLAKTVAFLRNLPSFWQLPPQDQRRLLQGCWGPLFLLGLAQDAVTFEVAEAPVPSILKKILLEEPSSSGGSGQLPDRPQPSLAAVQWLQCCLESFWSLELSPKEYACLKGTILFNPDVPGLQAASHIGHLQQEAHWVLCEVLEPWCPAAQGRLTRVLLTASTLKSIPTSLLGDLFFRPIIGDVDIAGLLGDMLLLR

SEQ ID NO: 15415 - protein, 614 aa, Homo Sapiens
MTTLDSNNNTGGVITYIGSSGSSPSRTSPESLYSDNSNGSFQSLTQGCPTYFPPSPTGSLTQDPARSFGSIPPSLSDDGSPSSSSSSSSSSSSFYNGSPPGSLQVAMEDSSRVSPSKSTSNITKLNGMVLLCKVCGDVASGFHYGVHACEGCKGFFRRSIQQNIQYKRCLKNENCSIVRINRNRCQQCRFKKCLSVGMSRDAVRFGRIPKREKQRMLAEMQSAMNLANNQLSSQCPLETSPTQHPTPGPMGPSPPPAPVPSPLVGFSQFPQQLTPPRSPSPEPTVEDVISQVARAHREIFTYAHDKLGSSPGNFNANHASGSPPATTPHRWENQGCPPAPNDNNTLAAQRHNEALNGLRQAPSSYPPTWPPGPAHHSCHQSNSNGHRLCPTHVYAAPEGKAPANSPRQGNSKNVLLACPMNMYPHGRSGRTVQEIWEDFSMSFTPAVREVVEFAKHIPGFRDLSQHDQVTLLKAGTFEVLMVRFASLFNVKDQTVMFLSRTTYSLQELGAMGMGDLLSAMFDFSEKLNSLALTEEELGLFTAVVLVSADRSGMENSASVEQLQETLLRALRALVLKNRPLETSRFTKLLLKLPDLRTLNNMHSEKLLSFRVDAQ

SEQ ID NO: 15416 - protein, 579 aa, Homo Sapiens
MEVNAGGVIAYISSSSSASSPASCHSEGSENSFQSSSSSVPSSPNSSNSDTNGNPKNGDLANIEGILKNDRIDCSMKTSKSSAPGMTKSHSGVTKFSGMVLLCKVCGDVASGFHYGVHACEGCKGFFRRSIQQNIQYKKCLKNENCSIMRMNRNRCQQCRFKKCLSVGMSRDAVRFGRIPKREKQRMLIEMQSAMKTMMNSQFSGHLQNDTLVEHHEQTALPAQEQLRPKPQLEQENIKSSSPPSSDFAKEEVIGMVTRAHKDTFMYNQEQQENSAESMQPQRGERIPKNMEQYNLNHDHCGNGLSSHFPCSESQQHLNGQFKGRNIMHYPNGHAICIANGHCMNFSNAYTQRVCDRVPIDGFSQNENKNSYLCNTGGRMHLVCPLSKSPYVDPHKSGHEIWEEFSMSFTPAVKEVVEFAKRIPGFRDLSQHDQVNLLKAGTFEVLMVRFASLFDAKERTVTFLSGKKYSVDDLHSMGAGDLLNSMFEFSEKLNALQLSDEEMSLFTAVVLVSADRSGIENVNSVEALQETLIRALRTLIMKNHPNEASIFTKLLLKLPDLRSLNNMHSEELLAFKVHP

SEQ ID NO: 15417 - protein, 460 aa, Homo Sapiens
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCVLSEEQIRKKKIRKQQQESQSQSQSPVGPQGSSSSASGPGASPGGSEAGSQGSGEGEGVQLTAAQELMIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 15418 - protein, 447 aa, Homo Sapiens
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 15419 - protein, 486 aa, Homo Sapiens
MVMQFQGLENPIQISPHCSCTPSGFFMEMMSMKPAKGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECMYTGLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 15420 - protein, 434 aa, Homo Sapiens
MEVRPKESWNHADFVHCEDTESVPGKPSVNADEEVGGPQICRVCGDKATGYHFNVMTCEGCKGFFRRAMKRNARLRCPFRKGACEITRKTRRQCQACRLRKCLESGMKKEMIMSDEAVEERRALIKRKKSERTGTQPLGVQGLTEEQRMMIRELMDAQMKTFDTTFSHFKNFRLPGVLSSGCELPESLQAPSREEAAKWSQVRKDLCSLKVSLQLRGEDGSVWNYKPPADSGGKEIFSLLPHMADMSTYMFKGIISFAKVISYFRDLPIEDQISLLKGAAFELCQLRFNTVFNAETGTWECGRLSYCLEDTAGGFQQLLLEPMLKFHYMLKKLQLHEEEYVLMQAISLFSPDRPGVLQHRVVDQLQEQFAITLKSYIECNRPQPAHRFLFLKIMAMLTELRSINAQHTQRLLRIQDIHPFATPLMQELFGITGS

SEQ ID NO: 15421 - protein, 352 aa, Homo Sapiens
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVSPTVGFQVEFLELLFHFHGTLRKLQLQEPEYVLLAAMALFSPDRPGVTQRDEIDQLQEEMALTLQSYIKGQQRRPRDRFLYAKLLGLLAELRSINEAYGYQIQHIQGLSAMMPLLQEICS

SEQ ID NO: 15422 - protein, 603 aa, Homo Sapiens
MATIEEIAHQIIEQQMGEIVTEQQTGQKIQIVTALDHNTQGKQFILTNHDGSTPSKVILARQDSTPGKVFLTTPDAAGVNQLFFTTPDLSAQHLQLLTDNSPDQGPNKVFDLCVVCGDKASGRHYGAVTCEGCKGFFKRSIRKNLVYSCRGSKDCIINKHHRNRCQYCRLQRCIAFGMKQDSVQCERKPIEVSREKSSNCAASTEKIYIRKDLRSPLTATPTFVTDSESTRSTGLLDSGMFMNIHPSGVKTESAVLMTSDKAESCQGDLSTLANVVTSLANLGKTKDLSQNSNEMSMIESLSNDDTSLCEFQEMQTNGDVSRAFDTLAKALNPGESTACQSSVAGMEGSVHLITGDSSINYTEKEGPLLSDSHVAFRLTMPSPMPEYLNVHYIGESASRLLFLSMHWALSIPSFQALGQENSISLVKAYWNELFTLGLAQCWQVMNVATILATFVNCLHNSLQQDKMSTERRKLLMEHIFKLQEFCNSMVKLCIDGYEYAYLKAIVLFSPDHPSLENMEQIEKFQEKAYVEFQDYITKTYPDDTYRLSRLLLRLPALRLMNATITEELFFKGLIGNIRIDSVIPHILKMEPADYNSQIIGHSI

SEQ ID NO: 15423 - protein, 596 aa, Homo Sapiens
MTSPSPRIQIISTDSAVASPQRIQIVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQDCIINKHHRNRCQFCRLKKCLEMGMKMESVQSERKPFDVQREKPSNCAASTEKIYIRKDLRSPLIATPTFVADKDGARQTGLLDPGMLVNIQQPLIREDGTVLLATDSKAETSQGALGTLANVVTSLANLSESLNNGDTSEIQPEDQSASEITRAFDTLAKALNTTDSSSSPSLADGIDTSGGGSIHVISRDQSTPIIEVEGPLLSDTHVTFKLTMPSPMPEYLNVHYICESASRLLFLSMHWARSIPAFQALGQDCNTSLVRACWNELFTLGLAQCAQVMSLSTILAAIVNHLQNSIQEDKLSGDRIKQVMEHIWKLQEFCNSMAKLDIDGYEYAYLKAIVLFSPDHPGLTSTSQIEKFQEKAQMELQDYVQKTYSEDTYRLARILVRLPALRLMSSNITEELFFTGLIGNVSIDSIIPYILKMETAEYNGQITGASL

SEQ ID NO: 15424 - protein, 385 aa, Homo Sapiens
MSKPAGSTSRILDIPCKVCGDRSSGKHYGVYACDGCSGFFKRSIRRNRTYVCKSGNQGGCPVDKTHRNQCRACRLKKCLEVNMNKDAVQHERGPRTSTIRKQVALYFRGHKEENGAAAHFPSAALPAPAFFTAVTQLEPHGLELAAVSTTPERQTLVSLAQPTPKYPHEVNGTPMYLYEVATESVCESAARLLFMSIKWAKSVPAFSTLSLQDQLMLLEDAWRELFVLGIAQWAIPVDANTLLAVSGMNGDNTDSQKLNKIISEIQALQEVVARFRQLRLDATEFACLKCIVTFKAVPTHSGSELRSFRNAAAIAALQDEAQLTLNSYIHTRYPTQPCRFGKLLLLLPALRSISPSTIEEVFFKKTIGNVPITRLLSDMYKSSDI

SEQ ID NO: 15425 - protein, 410 aa, Homo Sapiens
METRPTALMSSTVAAAAPAAGAASRKESPGRWGLGEDPTGVSPSLQCRVCGDSSSGKHYGIYACNGCSGFFKRSVRRRLIYRCQVGAGMCPVDKAHRNQCQACRLKKCLQAGMNQDAVQNERQPRSTAQVHLDSMESNTESRPESLVAPPAPAGRSPRGPTPMSAARALGHHFMASLITAETCAKLEPEDADENIDVTSNDPEFPSSPYSSSSPCGLDSIHETSARLLFMAVKWAKNLPVFSSLPFRDQVILLEEAWSELFLLGAIQWSLPLDSCPLLAPPEASAAGGAQGRLTLASMETRVLQETISRFRALAVDPTEFACMKALVLFKPETRGLKDPEHVEALQDQSQVMLSQHSKAHHPSQPVRFGKLLLLLPSLRFITAERIELLFFRKTIGNTPMEKLLCDMFKN

SEQ ID NO: 15426 - protein, 423 aa, Homo Sapiens
MAMVVSSWRDPQDDVAGGNPGGPNPAAQAARGGGGGAGEQQQQAGSGAPHTPQTPGQPGAPATPGTAGDKGQGPPGSGQSQQHIECVVCGDKSSGKHYGQFTCEGCKSFFKRSVRRNLTYTCRANRNCPIDQHHRNQCQYCRLKKCLKVGMRREAVQRGRMPPTQPNPGQYALTNGDPLNGHCYLSGYISLLLRAEPYPTSRYGSQCMQPNNIMGIENICELAARLLFSAVEWARNIPFFPDLQITDQVSLLRLTWSELFVLNAAQCSMPLHVAPLLAAAGLHASPMSADRVVAFMDHIRIFQEQVEKLKALHVDSAEYSCLKAIVLFTSDACGLSDAAHIESLQEKSQCALEEYVRSQYPNQPSRFGKLLLRLPSLRTVSSSVIEQLFFVRLVGKTPIETLIRDMLLSGSSFNWPYMSIQCS

SEQ ID NO: 15427 - protein, 414 aa, Homo Sapiens
MAMVVSTWRDPQDEVPGSQGSQASQAPPVPGPPPGAPHTPQTPGQGGPASTPAQTAAGGQGGPGGPGSDKQQQQQHIECVVCGDKSSGKHYGQFTCEGCKSFFKRSVRRNLSYTCRANRNCPIDQHHRNQCQYCRLKKCLKVGMRREAVQRGRMPPTQPTHGQFALTNGDPLNCHSYLSGYISLLLRAEPYPTSRFGSQCMQPNNIMGIENICELAARMLFSAVEWARNIPFFPDLQITDQVALLRLTWSELFVLNAAQCSMPLHVAPLLAAAGLHASPMSADRVVAFMDHIRIFQEQVEKLKALHVDSAEYSCLKAIVLFTSDACGLSDVAHVESLQEKSQCALEEYVRSQYPNQPTRFGKLLLRLPSLRTVSSSVIEQLFFVRLVGKTPIETLIRDMLLSGSSFNWPYMAIQ

SEQ ID NO: 15428 - protein, 404 aa, Homo Sapiens
MAMVTGGWGGPGGDTNGVDKAGGYPRAAEDDSASPPGAASDAEPGDEERPGLQVDCVVCGDKSSGKHYGVFTCEGCKSFFKRSIRRNLSYTCRSNRDCQIDQHHRNQCQYCRLKKCFRVGMRKEAVQRGRIPHSLPGAVAASSGSPPGSALAAVASGGDLFPGQPVSELIAQLLRAEPYPAAAGRFGAGGGAAGAVLGIDNVCELAARLLFSTVEWARHAPFFPELPVADQVALLRLSWSELFVLNAAQAALPLHTAPLLAAAGLHAAPMAAERAVAFMDQVRAFQEQVDKLGRLQVDSAEYGCLKAIALFTPDACGLSDPAHVESLQEKAQVALTEYVRAQYPSQPQRFGRLLLRLPALRAVPASLISQLFFMRLVGKTPIETLIRDMLLSGSTFNWPYGSGQ

SEQ ID NO: 15429 - protein, 777 aa, Homo Sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 15430 - protein, 984 aa, Homo Sapiens
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAIVKSPIMCHEKSPSVCSPLNMTSSVCSPAGINSVSSTTASFGSFPVHSPITQGTPLTCSPNAENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGARKSKKLGKLKGIHEEQPQQQQPPPPPPPPQSPEEGTTYIAPAKEPSVNTALVPQLSTISRALTPSPVMVLENIEPEIVYAGYDSSKPDTAENLLSTLNRLAGKQMIQVVKWAKVLPGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 15431 - protein, 598 aa, Homo Sapiens
MPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 15432 - protein, 598 aa, Homo Sapiens
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 15433 - protein, 626 aa, Homo Sapiens
MPCVQAQYSPSPPGSSYAAQTYSSEYTTEIMNPDYTKLTMDLGSTEITATATTSLPSISTFVEGYSSNYELKPSCVYQMQRPLIKVEEGRAPSYHHHHHHHHHHHHHHQQQHQQPSIPPASSPEDEVLPSTSMYFKQSPPSTPTTPAFPPQAGALWDEALPSAPGCIAPGPLLDPPMKAVPTVAGARFPLFHFKPSPPHPPAPSPAGGHHLGYDPTAAAALSLPLGAAAAAGSQAAALESHPYGLPLAKRAAPLAFPPLGLTPSPTASSLLGESPSLPSPPSRSSSSGEGTCAVCGDNAACQHYGVRTCEGCKGFFKRTVQKNAKYVCLANKNCPVDKRRRNRCQYCRFQKCLSVGMVKEVVRTDSLKGRRGRLPSKPKSPLQQEPSQPSPPSPPICMMNALVRALTDSTPRDLDYSRYCPTDQAAAGTDAEHVQQFYNLLTASIDVSRSWAEKIPGFTDLPKEDQTLLIESAFLELFVLRLSIRSNTAEDKFVFCNGLVLHRLQCLRGFGEWLDSIKDFSLNLQSLNLDIQALACLSALSMITERHGLKEPKRVEELCNKITSSLKDHQSKGQALEPTESKVLGALVELRKICTLGLQRIFYLKLEDLVSPPSIIDKLFLDTLPF

SEQ ID NO: 15434 - protein, 461 aa, Homo Sapiens
MDYSYDEDLDELCPVCGDKVSGYHYGLLTCESCKGFFKRTVQNNKHYTCTESQSCKIDKTQRKRCPFCRFQKCLTVGMRLEAVRADRMRGGRNKFGPMYKRDRALKQQKKAQIRANGFKLETGPPMGVPPPPPPAPDYVLPPSLHGPEPKGLAAGPPAGPLGDFGAPALPMAVPGAHGPLAGYLYPAFPGRAIKSEYPEPYASPPQPGLPYGYPEPFSGGPNVPELILQLLQLEPDEDQVRARILGCLQEPTKSRPDQPAAFGLLCRMADQTFISIVDWARRCMVFKELEVADQMTLLQNCWSELLVFDHIYRQVQHGKEGSILLVTGQEVELTTVATQAGSLLHSLVLRAQELVLQLLALQLDRQEFVCLKFIILFSLDLKFLNNHILVKDAQEKANAALLDYTLCHYPHCGDKFQQLLLCLVEVRALSMQAKEYLYHKHLGNEMPRNNLLIEMLQAKQT

SEQ ID NO: 15435 - protein, 541 aa, Homo Sapiens
MSSNSDTGDLQESLKHGLTPIGAGLPDRHGSPIPARGRLVMLPKVETEALGLARSHGEQGQMPENMQVSQFKMVNYSYDEDLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKVDDQMKLLQNCWSELLILDHIYRQVVHGKEGSIFLVTGQQVDYSIIASQAGATLNNLMSHAQELVAKLRSLQFDQREFVCLKFLVLFSLDVKNLENFQLVEGVQEQVNAALLDYTMCNYPQQTEKFGQLLLRLPEIRAISMQAEEYLYYKHLNGDVPYNNLLIEMLHAKRA

SEQ ID NO: 15436 - protein, 480 aa, Homo Sapiens
MERDEPPPSGGGGGGGSAGFLEPPAALPPPPRNGFCQDELAELDPGTISVSDDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVGKE

SEQ ID NO: 15437 - protein, 772 aa, Homo Sapiens; identical to SEQ ID NO: 9337

SEQ ID NO: 15438 - protein, 503 aa, Homo Sapiens
MEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQAQLRAFIPEMLKYSTGRGKPGWGKESCKPIWWPEDIPWANVRSDVRTEEQKQRVSWTQALRTIVKNCYKQHGREDLLYAFEDQQTQTQATATHSIAHLVPSQTVVQTFSNPDGTVSLIQVGTGATVATLADASELPTTVTVAQVNYSAVADGEVEQNWATLQGGEMTIQTTQASEATQAVASLAEAAVAASQEMQQGATVTMALNSEAAAHAVATLAEATLQGGGQIVLSGETAAAVGALTGVQDANGLVQIPVSMYQTVVTSLAQGNGPVQVAMAPVTTRISDSAVTMDGQAVEVVTLEQ

SEQ ID NO: 15439 - protein, 237 aa, Homo Sapiens
MALPPSPLAMEYVNDFDLMKFEVKREPSEGRPGPPTASLGSTPYSSVPPSPTFSEPGMVGATEGTRPGLEELYWLATLQQQLGAGEALGLSPEEAMELLQGQGPVPVDGPHGYYPGSPEETGAQHVQLAERFSDAALVSMSVRELNRQLRGCGRDEALRLKQRRRTLKNRGYAQACRSKRLQQRRGLEAERARLAAQLDALRAEVARLARERDLYKARCDRLTSSGPGSGDPSHLFL

SEQ ID NO: 15440 - protein, 271 aa, Homo Sapiens
MYYAVSQARVNAVPGTMLRPQRPGDLQLGASLYELVGYRQPPSSSSSSTSSTSSTSSSSTTAPLLPKAAREKPEAPAEPPGPGPGSGAHPGGSARPDAKEEQQQQLRRKINSRERKRMQDLNLAMDALREVILPYSAAHCQGAPGRKLSKIATLLLARNYILLLGSSLQELRRALGEGAGPAAPRLLLAGLPLLAAAPGSVLLAPGAVGPPDALRPAKYLSLALDEPPCGQFALPGGGAGGPGLCTCAVCKFPHLVPASLGLAAVQAQFSK

SEQ ID NO: 15441 - protein, 323 aa, Homo Sapiens
MDSDASLVSSRPSSPEPDDLFLPARSKGSSGSAFTGGTVSSSTPSDCPPELSAELRGAMGSAGAHPGDKLGGSGFKSSSSSTSSSTSSAAASSTKKDKKQMTEPELQQLRLKINSRERKRMHDLNIAMDGLREVMPYAHGPSVRKLSKIATLLLARNYILMLTNSLEEMKRLVSEIYGGHHAGFHPSACGGLAHSAPLPAATAHPAAAAHAAHHPAVHHPILPPAAAAAAAAAAAAAVSSASLPGSGLPSVGSIRPPHGLLKSPSAAAAAPLGGGGGGSGASGGFQHWGGMPCPCSMCQVPPPHHHVSAMGAGSLPRLTSDAK

SEQ ID NO: 15442 - protein, 272 aa, Homo Sapiens
MNSDSSSVSSRASSPDMDEMYLRDHHHRHHHHQESRLNSVSSTQGDMMQKMPGESLSRAGAKAAGESSKYKIKKQLSEQDLQQLRLKINGRERKRMHDLNLAMDGLREVMPYAHGPSVRKLSKIATLLLARNYILMLTSSLEEMKRLVGEIYGGHHSAFHCGTVGHSAGHPAHAANSVHPVHPILGGALSSGNASSPLSAASLPAIGTIRPPHSLLKAPSTPPALQLGSGFQHWAGLPCPCTICQMPPPPHLSALSTANMARLSAESKDLLK

SEQ ID NO: 15443 - protein, 465 aa, Homo Sapiens
MNAQLTMEAIGELHGVSHEPVPAPADLLGGSPHARSSVAHRGSHLPPAHPRSMGMASLLDGGSGGGDYHHHHRAPEHSLAGPLHPTMTMACETPPGMSMPTTYTTLTPLQPLPPISTVSDKFPHHHHHHHHHHHPHHHQRLAGNVSGSFTLMRDERGLASMNNLYTPYHKDVAGMGQSLSPLSSSGLGSIHNSQQGLPHYAHPGAAMPTDKMLTPNGFEAHHPAMLGRHGEQHLTPTSAGMVPINGLPPHHPHAHLNAQGHGQLLGTAREPNPSVTGAQVSNGSNSGQMEEINTKEVAQRITTELKRYSIPQAIFAQRVLCRSQGTLSDLLRNPKPWSKLKSGRETFRRMWKWLQEPEFQRMSALRLAACKRKEQEHGKDRGNTPKKPRLVFTDVQRRTLHAIFKENKRPSKELQITISQQLGLELSTVSNFFMNARRRSLDKWQDEGSSNSGNSSSSSSTCTKA

SEQ ID NO: 15444 - protein, 504 aa, Homo Sapiens
MKAAYTAYRCLTKDLEGCAMNPELTMESLGTLHGPAGGGSGGGGGGGGGGGGGGPGHEQELLASPSPHHAGRGAAGSLRGPPPPPTAHQELGTAAAAAAAASRSAMVTSMASILDGGDYRPELSIPLHHAMSMSCDSSPPGMGMSNTYTTLTPLQPLPPISTVSDKFHHPHPHHHPHHHHHHHHQRLSGNVSGSFTLMRDERGLPAMNNLYSPYKEMPGMSQSLSPLAATPLGNGLGGLHNAQQSLPNYGPPGHDKMLSPNFDAHHTAMLTRGEQHLSRGLGTPPAAMMSHLNGLHHPGHTQSHGPVLAPSRERPPSSSSGSQVATSGQLEEINTKEVAQRITAELKRYSIPQAIFAQRVLCRSQGTLSDLLRNPKPWSKLKSGRETFRRMWKWLQEPEFQRMSALRLAACKRKEQEPNKDRNNSQKKSRLVFTDLQRRTLFAIFKENKRPSKEMQITISQQLGLELTTVSNFFMNARRRSLEKWQDDLSTGGSSSTSSTCTKA

SEQ ID NO: 15445 - protein, 494 aa, Homo Sapiens
MELSLESLGGLHSVAHAQAGELLSPGHARSAAAQHRGLVAPGRPGLVAGMASLLDGGGGGGGGGAGGAGGAGSAGGGADFRGELAGPLHPAMGMACEAPGLGGTYTTLTPLQHLPPLAAVADKFHQHAAAAAVAGAHGGHPHAHPHPAAAPPPPPPPQRLAASVSGSFTLMRDERAALASVGHLYGPYGKELPAMGSPLSPLPNALPPALHGAPQPPPPPPPPPLAAYGPPGHLAGDKLLPPAAFEPHAALLGRAEDALARGLPGGGGGTGSGGAGSGSAAGLLAPLGGLAAAGAHGPHGGGGGPGGSGGGPSAGAAAEEINTKEVAQRITAELKRYSIPQAIFAQRILCRSQGTLSDLLRNPKPWSKLKSGRETFRRMWKWLQEPEFQRMSALRLAACKRKEQEQQKERALQPKKQRLVFTDLQRRTLIAIFKENKRPSKEMQVTISQQLGLELNTVSNFFMNARRRCMNRWAEEPSTAPGGPAGATATFSKA

SEQ ID NO: 15446 - protein, 266 aa, Homo Sapiens
MGSKTLPAPVPIHPSLQLTNYSFLQAVNGLPTVPSDHLPNLYGFSALHAVHLHQWTLGYPAMHLPRSSFSKVPGTVSSLVDARFQLPAFPWFPHVIQPKPEITAGGSVPALKTKPRFDFANLALAATQEDPAKLGRGEGPGSPAGGLGALLDVTKLSPEKKPTRGRLPSKTKKEFVCKFCGRHFTKSYNLLIHERTHTDERPYTCDICHKAFRRQDHLRDHRYIHSKEKPFKCQECGKGFCQSRTLAVHKTLHSQVKELKTSKIKC

SEQ ID NO: 15447 - protein, 312 aa, Homo Sapiens
MGSKALPAPIPLHPSLQLTNYSFLQAVNTFPATVDHLQGLYGLSAVQTMHMNHWTLGYPNVHEITRSTITEMAAAQGLVDARFPFPALPFTTHLFHPKQGAIAHVLPALHKDRPRFDFANLAVAATQEDPPKMGDLSKLSPGLGSPISGLSKLTPDRKPSRGRLPSKTKKEFICKFCGRHFTKSYNLLIHERTHTDERPYTCDICHKAFRRQDHLRDHRYIHSKEKPFKCQECGKGFCQSRTLAVHKTLHMQESPHKCPTCGRTFNQRSNLKTHLLTHTDIKPYSCEQCGKVFRRNCDLRRHSLTHTPRQDF

SEQ ID NO: 15448 - protein, 325 aa, Homo Sapiens
MLSHADLLDARLGMKDAAELLGHREAVKCRLGVGGSDPGGHPGDLAPNSDPVEGATLLPGEDITTVGSTPASLAVSAKDPDKQPGPQGGPNPSQAGQQQGQQKQKRHRTRFTPAQLNELERSFAKTHYPDIFMREELALRIGLTESRVQVWFQNRRAKWKKRKKTTNVFRAPGTLLPTPGLPQFPSAAAAAAAAMGDSLCSFHANDTRWAAAAMPGVSQLPLPPALGRQQAMAQSLSQCSLAAGPPPNSMGLSNSLAGSNGAGLQSHLYQPAFPGMVPASLPGPSNVSGSPQLCSSPDSSDVWRGTSIASLRRKALEHTVSMSFT

SEQ ID NO: 15449 - protein, 354 aa, Homo Sapiens
MMSYLKQPPYGMNGLGLAGPAMDLLHPSVGYPATPRKQRRERTTFTRSQLDVLEALFAKTRYPDIFMREEVALKINLPESRVQVWFKNRRAKCRQQQQSGSGTKSRPAKKKSSPVRESSGSESSGQFTPPAVSSSASSSSSASSSSANPAAAAAAGLGGNPVAAASSLSTPAASSIWSPASISPGSAPASVSVPEPLAAPSNTSCMQRSVAAGAATAAASYPMSYGQGGSYGQGYPTPSSSYFGGVDCSSYLAPMHSHHHPHQLSPMAPSSMAGHHHHHPHAHHPLSQSSGHHHHHHHHHHQGYGGSGLAFNSADCLDYKEPGAAAASSAWKLNFNSPDCLDYKDQASWRFQVL

SEQ ID NO: 15450 - protein, 289 aa, Homo Sapiens
MMSYLKQPPYAVNGLSLTTSGMDLLHPSVGYPATPRKQRRERTTFTRAQLDVLEALFAKTRYPDIFMREEVALKINLPESRVQVWFKNRRAKCRQQQQQQQNGGQNKVRPAKKKTSPAREVSSESGTSGQFTPPSSTSVPTIASSSAPVSIWSPASISPLSDPLSTSSSCMQRSYPMTYTQASGYSQGYAGSTSYFGGMDCGSYLTPMHHQLPGPGATLSPMGTNAVTSHLNQSPASLSTQGYGASSLGFNSTTDCLDYKDQTASWKLNFNADCLDYKDQTSSWKFQVL

SEQ ID NO: 15451 - protein, 267 aa, Homo Sapiens
MPRAFLVKKPCVSTCKRNWSELPDEERGEIYVPVSLGFCPPQPYREPEPSVAEPPSCPLALNMSLRDSSYSMAPGPCVVAQLPSEDMGHLTDPQSRDHGFLRTKMKVTLGDSPSGDLFTCRVCQKAFTYQRMLNRHMKCHNDVKRHLCTYCGKGFNDTFDLKRHVRTHTGVRPYKCSLCDKAFTQRCSLESHLKKIHGVQQKYAYKERRAKLYVCEECGCTSESQEGHVLHLKEHHPDSPLLRKTSKKVAVALQNTVTSLLQGSPHL

SEQ ID NO: 15452 - protein, 275 aa, Homo Sapiens
MPKVFLVKRRSLGVSVRSWDELPDEKRADTYIPVGLGRLLHDPPEDCRSDGGSSSGSGSSSAGEPGGAESSSSPHAPESETPEPGDAEGPDGHLATKQRPVARSKIKFTTGTCSDSVVHSCDLCGKGFRLQRMLNRHLKCHNQVKRHLCTFCGKGFNDTFDLKRHVRTHTGIRPYKCNVCNKAFTQRCSLESHLKKIHGVQQQYAYKQRRDKLYVCEDCGYTGPTQEDLYLHVNSAHPGSSFLKKTSKKLAALLQGKLTSAHQENTSLSEEEERK

SEQ ID NO: 15453 - protein, 214 aa, Homo Sapiens
MPRAFLVRSRRPQPPNWGHLPDQLRGDAYIPGGPLTVPGGKGQERRSVTIWLFSSDCSSLGGPPAQQSSSVRDPWTAQPTQGNLTSAPRGPGTLGCPLCPKAFPLQRMLTRHLKCHSPVRRHLCRCCGKGFHDAFDLKRHMRTHTGIRPFRCSACGKAFTQRCSLEAHLAKVHGQPASYAYRERREKLHVCEDCGFTSSRPDTYAQHRALHRAA

SEQ ID NO: 15454 - protein, 1014 aa, Homo Sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKVCSTNDLKELLIFNKQQVPSGESAILDRVADGMVFGALLPCEECSGQLVFKSDAYYCTGDVTAWTKCMVKTQTPNRKEWVTPKEFREISYLKKLKVKKQDRIFPPETSASVAATPPPSTASAPAAVNSSASADKPLSNMKILTLGKLSRNKDEVKAMIEKLGGKLTGTANKASLCISTKKEVEKMNKKMEEVKEANIRVVSEDFLQDVSASTKSLQELFLAHILSPWGAEVKAEPVEVVAPRGKSGAALSKKSKGQVKEEGINKSEKRMKLTLKGGAAVDPDSGLEHSAHVLEKGGKVFSATLGLVDIVKGTNSYYKLQLLEDDKENRYWIFRSWGRVGTVIGSNKLEQMPSKEDAIEHFMKLYEEKTGNAWHSKNFTKYPKKFYPLEIDYGQDEEAVKKLTVNPGTKSKLPKPVQDLIKMIFDVESMKKAMVEYEIDLQKMPLGKLSKRQIQAAYSILSEVQQAVSQGSSDSQILDLSNRFYTLIPHDFGMKKPPLLNNADSVQAKVEMLDNLLDIEVAYSLLRGGSDDSSKDPIDVNYEKLKTDIKVVDRDSEEAEIIRKYVKNTHATTHNAYDLEVIDIFKIEREGECQRYKPFKQLHNRRLLWHGSRTTNFAGILSQGLRIAPPEAPVTGYMFGKGIYFADMVSKSANYCHTSQGDPIGLILLGEVALGNMYELKHASHISKLPKGKHSVKGLGKTTPDPSANISLDGVDVPLGTGISSGVNDTSLLYNEYIVYDIAQVNLKYLLKLKFNFKTSLW

SEQ ID NO: 15455 - protein, 701 aa, Homo Sapiens
MAQAGVVGEVTQVLCAAGGALELPELRRRLRMGLSADALERLLRQRGRFVVAVRAGGAAAAPERVVLAASPLRLCRAHQGSKPGCVGLCAQLHLCRFMVYGACKFLRAGKNCRNSHSLTTEHNLSVLRTHGVDHLSYNELCQLLFQNDPWLLPEICQHYNKGDGPHGSCAFQKQCIKLHICQYFLQGECKFGTSCKRSHDFSNSENLEKLEKLGMSSDLVSRLPTIYRNAHDIKNKSSAPSRVPPLFVPQGTSERKDSSGSVSPNTLSQEEGDQICLYHIRKSCSFQDKCHRVHFHLPYRWQFLDRGKWEDLDNMELIEEAYCNPKIERILCSESASTFHSHCLNFNAMTYGATQARRLSTASSVTKPPHFILTTDWIWYWSDEFGSWQEYGRQGTVHPVTTVSSSDVEKAYLAYCTPGSDGQAATLKFQAGKHNYELDFKAFVQKNLVYGTTKKVCRRPKYVSPQDVTTMQTCNTKFPGPKSIPDYWDSSALPDPGFQKITLSSSSEEYQKVWNLFNRTLPFYFVQKIERVQNLALWEVYQWQKGQMQKQNGGKAVDERQLFHGTSAIFVDAICQQNFDWRVCGVHGTSYGKGSYFARDAAYSHHYSKSDTQTHTMFLARVLVGEFVRGNASFVRPPAKEGWSNAFYDSCVNSVSDPSIFVIFEKHQVYPEYVIQYTTSSKPSVTPSILLALGSLFSSRQ

SEQ ID NO: 15456 - protein, 687 aa, Homo Sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGFSSASYLKVHVKTHHGVPLPQVSRHQEPILNGGAAFHCARTYGNKEGQKCSHQDPIESSDSYGDLSDASDLKTPEKQSANGSFSCDMAVPKNKMESDGEKKYPCPECGSFFRSKSYLNKHIQKVHVRALGGPLGDLGPALGSPFSPQQNMSLLESFGFQIVQSAFASSLVDPEVDQQPMGPEGK

SEQ ID NO: 15457 - protein, 340 aa, Homo Sapiens
MATGGYRTSSGLGGSTTDFLEEWKAKREKMRAKQNPPGPAPPGGGSSDAAGKPPAGALGTPAAAAANELNNNLPGGAPAAPAVPGPGGVNCAVGSAMLTRAAPGPRRSEDEPPAASASAAPPPQRDEEEPDGVPEKGKSSGPSARKGKGQIEKRKLREKRRSTGVVNIPAAECLDEYEDDEAGQKERKREDAITQQNTIQNEAVNLLDPGSSYLLQEPPRTVSGRYKSTTSVSEEDVSSRYSRTDRSGFPRYNRDANVSGTLVSSSTLEKKIEDLEKEVVRERQENLRLVRLMQDKEEMIGKLKEEIDLLNRDLDDIEDENEQLKQENKTLLKVVGQLTR

SEQ ID NO: 15458 - protein, 534 aa, Homo Sapiens
MKFTLGLGSRAWRVSWEGAAAAAAGPGAGGSALRCRAQRVSSPRLGRRGSRLSGALPLCLSRGGGGAQALPDCAGPSPGHPGHPGARQLAGPLAMEQTYGEVNQLGGVFVNGRPLPNAIRLRIVELAQLGIRPCDISRQLRVSHGCVSKILARYNETGSILPGAIGGSKPRVTTPNVVKHIRDYKQGDPGIFAWEIRDRLLADGVCDKYNVPSVSSISRILRNKIGSLAQPGPYEASKQPPSQPTLPYNHIYQYPYPSPVSPTGAKMGSHPGVPGTAGHVSIPRSWPSAHSVSNILGIRTFMEQTGALAGSEGTAYSPKMEDWAGVNRTAFPATPAVNGLEKPALEADIKYTQSASTLSAVGGFLPACAYPASNQHGVYSAPGGGYLAPGPPWPPAQGPPLAPPGAGVAVHGGELAAAMTFKHPSREGSLPAPAARPRTPSVAYTDCPSRPRPPRGSSPRTRARRERQADPGAQVCAAAPAIGTGRIGGLAEEEASAGPRGARPASPQAQPCLWPDPPHFLYWSGFLGFSELGF

SEQ ID NO: 15459 - protein, 417 aa, Homo Sapiens; identical to SEQ ID NO: 10021

SEQ ID NO: 15460 - protein, 479 aa, Homo Sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSKPWTF

SEQ ID NO: 15461 - protein, 350 aa, Homo Sapiens
MHQDGISSMNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWDCGSFLLPVIAPSCVDVAWPCLDASLAHHLIGGAGKATPTHFSHWP

SEQ ID NO: 15462 - protein, 391 aa, Homo Sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSEFSGSPYSHPQYSSYNDSWRFPNPGLLGSPYYYSAAARGAAPPAAATAYDRH

SEQ ID NO: 15463 - protein, 422 aa, Homo Sapiens [sequence omitted]

SEQ ID NO: 15464 - protein, 505 aa, Homo Sapiens
MAALPGTVPRMMRPAPGQNYPRTGFPLEVSTPLGQGRVNQLGGVFINGRPLPNHIRHKIVEMAHHGIRPCVISRQLRVSHGCVSKILCRYQETGSIRPGAIGGSKPRQVATPDVEKKIEEYKRENPGMFSWEIRDRLLKDGHCDRSTVPSGLVSSISRVLRIKFGKKEEEDEADKKEDDGEKKAKHSIDGILGDKGNRLDEGSDVESEPDLPLKRKQRRSRTTFTAEQLEELEKAFERTHYPDIYTREELAQRTKLTEARVQVWFSNRRARWRKQAGANQLAAFNHLLPGGFPPTGMPTLPPYQLPDSTYPTTTISQDGGSTVHRPQPLPPSTMHQGGLAAAAAAADTSSAYGARHSFSSYSDSFMNPAAPSNHMNPVSNGLSPQVMSILGNPSAVPPQPQADFSISPLHGGLDSATSISASCSQRADSIKPGDSLPTSQAYCPPTYSTTGYSVDPVAGYQYGQYGQTAVDYLAKNVSLSTQRRMKLGEHSAVLGLLPVETGQAY

SEQ ID NO: 15465 - protein, 450 aa, Homo Sapiens
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVADPHSPFAIKQETPEVSSSSSTPSSLSSSAFLDLQQVGSGVPPFNAFPHAASVYGQFTGQALLSGREMVGPTLPGYPPHIPTSGQGSYASSAIAGMVAGSEYSGNAYGHTPYSSYSEAWRFPNSSLLSSPYYYSSTSRPSAPPTTATAFDHL

SEQ ID NO: 15466 - protein, 341 aa, Homo Sapiens
MEPAFGEVNQLGGVFVNGRPLPNAIRLRIVELAQLGIRPCDISRQLRVSHGCVSKILARYNETGSILPGAIGGSKPRVTTPTVVKHIRTYKQRDPGIFAWEIRDRLLADGVCDKYNVPSVSSISRILRNKIGNLAQQGHYDSYKQHQPTPQPALPYNHIYSYPSPITAAAAKVPTPPGVPAIPGSVAMPRTWPSSHSVTDILGIRSITDQVSDSSPYHSPKVEEWSSLGRNNFPAAAPHAVNGLEKGALEQEAKYGQAPNGLPAVGSFVSASSMAPYPTPAQVSPYMTYSAAPSGYVAGHGWQHAGGTSLSPHNCDIPASLAFKGMQAAREGSHSVTASAL

SEQ ID NO: 15467 - protein, 917 aa, Homo Sapiens
MFRKARRVNVRKRNDSEEEERERDEEQEPPPLLPPPGTGEEAGPGGGDRAPGGESLLGPGPSPPSALTPGLGAEAGGGFPGGAEPGNGLKPRKRPRENKEVPRASLLSFQDEEEENEEVFKVKKSSYSKKIVKLLKKEYKEDLEKSKIKTELNSSAESEQPLDKTGHVKDTNQEDGVIISEHGEDEMDMESEKEEEKPKTGGAFSNALSSLNVLRPGEIPDAAFIHAARKKRQMARELGDFTPHDNEPGKGRLVREDENDASDDEDDDEKRRIVFSVKEKSQRQKIAEEIGIEGSDDDALVTGEQDEELSRWEQEQIRKGINIPQVQASQPAEVNMYYQNTYQTMPYGSSYGIPYSYTAYGSSDAKSQKTDNTVPFKTPSNEMTPVTIDLVKKQLKDRLDSMKELHKTNRQQHEKHLQSRVDSTRAIERLEGSSGGIGERYKFLQEMRGYVQDLLECFSEKVPLINELESAIHQLYKQRASRLVQRRQDDIKDESSEFSSHSNKALMAPNLDSFGRDRALYQEHAKRRIAEREARRTRRRQAREQTGKMADHLEGLSSDDEETSTDITNFNLEKDRISKESGKVFEDVLESFYSIDCIKSQFEAWRSKYYTSYKDAYIGLCLPKLFNPLIRLQLLTWTPLEAKCRDFENMLWFESLLFYGCEEREQEKDDVDVALLPTIVEKVILPKLTVIAENMWDPFSTTQTSRMVGITLKLINGYPSVVNAENKNTQVYLKALLLRMRRTLDDDVFMPLYPKNVLENKNSGPYLFFQRQFWSSVKLLGNFLQWYGIFSNKTLQELSIDGLLNRYILMAFQNSEYGDDSIKKAQNVINCFPKQWFMNLKGERTISQLENFCRYLVHLADTIYRNSIGCSDVEKRNARENIKQIVKLLASVRALDHAMSVASDHNVKEFKSLIEGK

SEQ ID NO: 15468 - protein, 1689 aa, Homo Sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEERAAKVAEQQERERAAQQQQPSASPRAGTPVGALMGVVPPPTPMGMLNQQLTPVAGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 15469 - protein, 430 aa, Homo Sapiens
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGSSSSFNMSNSGDLFMSVQSLNGDSYQGAQVGANVQSQVDTLRHVISQTGGYSDGLAASQMYSPQGISANGGWQDATTPSSVTSPTEGPGSVHSDTSN

SEQ ID NO: 15470 - protein, 430 aa, Homo Sapiens
MDERLLGPPPPGGGRGGLGLVSGEPGGPGEPPGGGDPGGGSGGVPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRTSSPTPPSSAGSGGSFNLSGSGDMFLGMPGLNGDSYSASQVESLRHSMGPGGYGDNLGGGQMYSPREMRANGSWQEAVTPSSVTSPTEGPGSVHSDTSN

SEQ ID NO: 15471 - protein, 434 aa, Homo Sapiens
MDDQSRMLQTLAGVNLAGHSVQGGMALPPPPHGHEGADGDGRKQDIGDILHQIMTITDQSLDEAQAKKHALNCHRMKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 15472 - protein, 374 aa, Homo Sapiens
MAAPPRPAPSPPAPRRLDTSDVLQQIMAITDQSLDEAQARKHALNCHRMKPALFSVLCEIKEKTVVSIRGIQDEDPPDAQLLRLDNMLLAEGVCRPEKRGRGGAVARAGTATPGGCPNDNSIEHSDYRAKLSQIRQIYHSELEKYEQACREFTTHVTNLLQEQSRMRPVSPKEIERMVGAIHGKFSAIQMQLKQSTCEAVMTLRSRLLDARRKRRNFSKQATEVLNEYFYSHLNNPYPSEEAKEELARKGGLTISQVSNWFGNKRIRYKKNMGKFQEEATIYTGKTAVDTTEVGVPGNHASCLSTPSSGSSGPFPLPSAGDAFLTLRTLASLQPPPGGGCLQSQAQGSWQGATPQPATASPAGDPGSINSSTSN

SEQ ID NO: 15473 - protein, 356 aa, Homo Sapiens
MDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAAGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 15474 - protein, 365 aa, Homo Sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLETLSQSPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSGIESSSPEVKGYWGLDASAQTTSHELTIPNDLIGCIIGRQGAKINEIRQMSGAQIKIANPVEGSTDRQVTITGSAASISLAQYLINVRLSSETGGMGSS

SEQ ID NO: 15475 - protein, 371 aa, Homo Sapiens
MGEGDAFWAPSVLPHSTLSTLSHHPQPQFGRRMESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLESPPKGATIPYRPKPASTPVIFAGGQAYTIQGQYAIPHPDQLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 15476 - protein, 403 aa, Homo Sapiens
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 15477 - protein, 350 aa, Homo Sapiens
MEGVAVVTAGSVGAAKTEGAAALPPPPPVSPPALTPAPAAGEEGPAPLSETGAPGCSGSRPPELEPERSLGRFRGRFEDEDEELEEEEELEEEEEEEEEDMSHFSLRLEGGRQDSEDEEERLINLSELTPYILCSICKGYLIDATTITECLHTFCKSCIVRHFYYSNRCPKCNIVVHQTQPLYNIRLDRQLQDIVYKLVINLEEREKKQMHDFYKERGLEVPKPAVPQPVPSSKGRSKKVLESVFRIPPELDMSLLLEFIGANEGTGHFKPLEKKFVRVSGEATIGHVEKFLRRKMGLDPACQVDIICGDHLLEQYQTLREIRRAIGDAAMQDGLLVLHYGLVVSPLKIT

SEQ ID NO: 15478 - protein, 501 aa, Homo Sapiens
MAASWRLGCDPRLLRYLVGFPGRRSVGLVKGALGWSVSRGANWRWFHSTQWLRGDPIKILMPSLSPTMEEGNIVKWLKKEGEAVSAGDALCEIETDKAVVTLDASDDGILAKIVVEEGSKNIRLGSLIGLIVEEGEDWKHVEIPKDVGPPPPVSKPSEPRPSPEPQISIPVKKEHIPGTLRFRLSPAARNILEKHSLDASQGTATGPRGIFTKEDALKLVQLKQTGKITESRPTPAPTATPTAPSPLQATAGPSYPRPVIPPVSTPGQPNAVGTFTEIPASNIRRVIAKRLTESKSTVPHAYATADCDLGAVLKVRQDLVKDDIKVSVNDFIIKAAAVTLKQMPDVNVSWDGEGPKQLPFIDISVAVATDKGLLTPIIKDAAAKGIQEIADSVKALSKKARDGKLLPEEYQGGSFSISNLGMFGIDEFTAVINPPQACILAVGRFRPVLKLTEDEEGNAKLQQRQLITVTMSSDSRVVDDELATRFLKSFKANLENPIRLA

SEQ ID NO: 15479 - protein, 283 aa, Homo Sapiens
MNGEEQYYAATQLYKDPCAFQRGPAPEFSASPPACLYMGRQPPPPPPHPFPGALGALEQGSPPDISPYEVPPLADDPAVAHLHHHLPAQLALPHPPAGPFPEGAEPGVLEEPNRVQLPFPWMKSTKAHAWKGQWAGGAYAAEPEENKRTRTAYTRAQLLELEKEFLFNKYISRPRRVELAVMLNLTERHIKIWFQNRRMKWKKEEDKKRGGGTAVGGGGVAEPEQDCAVTSGEELLALPPPPPPGGAVPPAAPVAAREGRLPPGLSASPQPSSVAPRRPQEPR

SEQ ID NO: 15480 - protein, 1588 aa, Homo Sapiens
MLPPKHLSATKPKKSWAPNLYELDSDLTKEPDVIIGEGPTDSEFFHQRFRNLIYVEFVGPRKTLIKLRNLCLDWLQPETRTKEEIIELLVLEQYLTIIPEKLKPWVRAKKPENCEKLVTLLENYKEMYQPEDDNNSDVTSDDDMTRNRRESSPPHSVHSFSDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLVQLAEDDGHSHMTQGHSSRSKRSAYPSTSRGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTFSELQKIYGKDKFYECRVCKETFLHSSALIEHQKIHFGDDKDNEREHERERERERGETFRPSPALNEFQKMYGKEKMYECKVCGETFLHSSSLKEHQKIHTRGNPFENKGKVCEETFIPGQSLKRRQKTYNKEKLCDFTDGRDAFMQSSELSEHQKIHSRKNLFEGRGYEKSVIHSGPFTESQKSHTITRPLESDEDEKAFTISSNPYENQKIPTKENVYEAKSYERSVIHSLASVEAQKSHSVAGPSKPKVMAESTIQSFDAINHQRVRAGGNTSEGREYSRSVIHSLVASKPPRSHNGNELVESNEKGESSIYISDLNDKRQKIPARENPCEGGSKNRNYEDSVIQSVFRAKPQKSVPGEGSGEFKKDGEFSVPSSNVREYQKARAKKKYIEHRSNETSVIHSLPFGEQTFRPRGMLYECQECGECFAHSSDLTEHQKIHDREKPSGSRNYEWSVIRSLAPTDPQTSYAQEQYAKEQARNKCKDFRQFFATSEDLNTNQKIYDQEKSHGEESQGENTDGEETHSEETHGQETIEDPVIQGSDMEDPQKDDPDDKIYECEDCGLGFVDLTDLTDHQKVHSRKCLVDSREYTHSVIHTHSISEYQRDYTGEQLYECPKCGESFIHSSFLFEHQRIHEQDQLYSMKGCDDGFIALLPMKPRRNRAAERNPALAGSAIRCLLCGQGFIHSSALNEHMRLHREDDLLEQSQMAEEAIIPGLALTEFQRSQTEERLFECAVCGESFVNPAELADHVTVHKNEPYEYGSSYTHTSFLTEPLKGAIPFYECKDCGKSFIHSTVLTKHKELHLEEEEEDEAAAAAAAAAQEVEANVHVPQVVLRIQGLNVEAAEPEVEAAEPEVEAAEPEVEAAEPNGEAEGPDGEAAEPIGEAGQPNGEAEQPNGDADEPDGAGIEDPEERAEEPEGKAEEPEGDADEPDGVGIEDPEEGEDQEIQVEEPYYDCHECTETFTSSTAFSEHLKTHASMIIFEPANAFGECSGYIERASTSTGGANQADEKYFKCDVCGQLFNDRLSLARHQNTHTG

SEQ ID NO: 15481 - protein, 933 aa, Homo Sapiens
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 15482 - protein, 272 aa, Homo Sapiens; identical to SEQ ID NO: 10322

SEQ ID NO: 15483 - protein, 299 aa, Homo Sapiens
MAQNLKDLAGRLPAGPRGMGTALKLLLGAGAVAYGVRESVFTVEGGHRAIFFNRIGGVQQDTILAEGLHFRIPWFQYPIIYDIRARPRKISSPTGSKDLQMVNISLRVLSRPNAQELPSMYQRLGLDYEERVLPSIVNEVLKSVVAKFNASQLITQRAQVSLLIRRELTERAKDFSLILDDVAITELSFSREYTAAVEAKQVAQQEAQRAQFLVEKAKQEQRQKIVQAEGEAEAAKMLGEALSKNPGYIKLRKIRAAQNISKTIATSQNRIYLTADNLVLNLQDESFTRGSDSLIKGKK

SEQ ID NO: 15484 - protein, 1012 aa, Homo Sapiens
MTKHPPNRRGISFEVGAQLEARDRLKNWYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKKKKKKKKKTKPECPCSEEISDTSQEPSPPKAFAVTRCGSSHKPGVHMSPQLHGPESGHHKGKVKALEEDNLSESSSESFLWSDDEYGQDVDVTTNPDEELDGDDRYDFEVVRCICEVQEENDFMIQCEECQCWQHGVCMGLLEENVPEKYTCYVCQDPPGQRPGFKYWYDKEWLSRGHMHGLAFLEENYSHQNAKKIVATHQLLGDVQRVIEVLHGLQLKMSILQSREHPDLPLWCQPWKQHSGEGRSHFRNIPVTDTRSKEEAPSYRTLNGAVEKPRPLALPLPRSVEESYITSEHCYQKPRAYYPAVEQKLVVETRGSALDDAVNPLHENGDDSLSPRLGWPLDQDRSKGDSDPKPGSPKVKEYVSKKALPEEAPARKLLDRGGEGLLSSQHQWQFNLLTHVESLQDEVTHRMDSIEKELDVLESWLDYTGELEPPEPLARLPQLKHCIKQLLMDLGKVQQIALCCST

SEQ ID NO: 15485 - protein, 110 aa, Homo Sapiens
MAKHHPDLIFCRKQAGVAIGRLCEKCDGKCVICDSYVRPCTLVRICDECNYGSYQGRCVICGGPGVSDAYYCKECTIQEKDRDGCPKIVNLGSSKTDLFYERKKYGFKKR

SEQ ID NO: 15486 - protein, 284 aa, Homo Sapiens
MDYSYLNSYDSCVAAMEASAYGDFGACSQPGGFQYSPLRPAFPAAGPPCPALGSSNCALGALRDHQPAPYSAVPYKFFPEPSGLHEKRKQRRIRTTFTSAQLKELERVFAETHYPDIYTREELALKIDLTEARVQVWFQNRRAKFRKQERAASAKGAAGAAGAKKGEARCSSEDDDSKESTCSPTPDSTASLPPPPAPGLASPRLSPSPLPVALGSGPGPGPGPQPLKGALWAGVAGGGGGGPGAGAAELLKAWQPAESGPGPFSGVLSSFHRKPGPALKTNLF

SEQ ID NO: 15487 - protein, 314 aa, Homo Sapiens
MYKMEYSYLNSSAYESCMAGMDTSSLASAYADFSSCSQASGFQYNPIRTTFGATSGCPSLTPGSCSLGTLRDHQSSPYAAVPYKLFTDHGGLNEKRKQRRIRTTFTSAQLKELERVFAETHYPDIYTREELALKIDLTEARVQVWFQNRRAKFRKQERAAAAAAAAAKNGSSGKKSDSSRDDESKEAKSTDPDSTGGPGPNPNPTPSCGANGGGGGGPSPAGAPGAAGPGGPGGEPGKGGAAAAAAAAAAAAAAAAAAAAGGLAAAGGPGQGWAPGPGPITSIPDSLGGPFASVLSSLQRPNGAKAALVKSSMF

SEQ ID NO: 15488 - protein, 762 aa, Homo Sapiens
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVLQGHKTFLNDAYNWEFLIWETALLLFLLRLASLGSETNKKYSNVSILLTEQINLYLKMEKKPNKKEQLTLVNNVLKLSTKLLKELDTPFRLYGLTMNPLIYNITRVVILSAVSGVISDLLGFNIRLWKIKS

SEQ ID NO: 15489 - protein, 785 aa, Homo Sapiens
MASKVTDAIVWYQKKEFLSVATTAPGPQQVLPGYCQCSLKDQGLFIQCLIGAYDQQIWEKSVEQREIKFIKLGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQLLHVHEIFLDCHYNWELVIWCISLTLFLLRFVTLGSETSKKYSNTSILLTEQINLYLKMEKKPNKKEELTLVNNVLKLATKLLKELDSPFRLYGLTMNPLLYNITQVVILSAVSGVISDLLGFNLKLWKIKS

SEQ ID NO: 15490 - protein, 314 aa, Homo Sapiens
MDAFKGGMSLERLPEGLRPPPPPPHDMGPAFHLARPADPREPLENSASESSDTELPEKERGGEPKGPEDSGAGGTGCGGADDPAKKKKQRRQRTHFTSQQLQELEATFQRNRYPDMSMREEIAVWTNLTEPRVRVWFKNRRAKWRKRERNQQLDLCKGGYVPQFSGLVQPYEDVYAAGYSYNNWAAKSLAPAPLSTKSFTFFNSMSPLSSQSMFSAPSSISSMTMPSSMGPGAVPGMPNSGLNNINNLTGSSLNSAMSPGACPYGTPASPYSVYRDTCNSSLASLRLKSKQHSSFGYGGLQGPASGLNACQYNS

SEQ ID NO: 15491 - protein, 317 aa, Homo Sapiens
METNCRKLVSACVQLGVQPAAVECLFSKDSEIKKVEFTDSPESRKEAASSKFFPRQHPGANEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 15492 - protein, 302 aa, Homo Sapiens
MEFGLLSEAEARSPALSLSDAGTPHPQLPEHGCKGQEHSDSEKASASLPGGSPEDGSLKKKQRRQRTHFTSQQLQELEATFQRNRYPDMSTREEIAVWTNLTEARVRVWFKNRRAKWRKRERSQQAELCKGSFAAPLGGLVPPYEEVYPGYSYGNWPPKALAPPLAAKTFPFAFNSVNVGPLASQPVFSPPSSIAASMVPSAAAAPGTVPGPGALQGLGGGPPGLAPAAVSSGAVSCPYASAAAAAAAAASSPYVYRDPCNSSLASLRLKAKQHASFSYPAVHGPPPAANLSPCQYAVERPV

SEQ ID NO: 15493 - protein, 436 aa, Homo Sapiens
MMATQTLSIDSYQDGQQMQVVTELKTEQDPNCSEPDAEGVSPPPVESQTPMDVDKQAIYRHPLFPLLALLFEKCEQSTQGSEGTTSASFDVDIENFVRKQEKEGKPFFCEDPETDNLMVKAIQVLRIHLLELEKVNELCKDFCSRYIACLKTKMNSETLLSGEPGSPYSPVQSQQIQSAITGTISPQGIVVPASALQQGNVAMATVAGGTVYQPVTVVTPQGQVVTQTLSPGTIRIQNSQLQLQLNQDLSILHQDDGSSKNKRGVLPKHATNVMRSWLFQHIGHPYPTEDEKKQIAAQTNLTLLQVNNWFINARRRILQPMLDSSCSETPKTKKKTAQNRPVQRFWPDSIASGVAQPPPSELTMSEGAVVTITTPVNMNVDSLQSLSSDGATLAVQQVMMAGQSEDESVDSTEEDAGALAPAHISGLVLENSDSLQ

SEQ ID NO: 15494 - protein, 472 aa, Homo Sapiens
MMQHASPAPALTMMATQNVPPPPYQDSPQMTATAQPPSKAQAVHISAPSAAASTPVPSAPIDPQAQLEADKRAVYRHPLFPLLTLLFEKCEQATQGSECITSASFDVDIENFVHQQEQEHKPFFSDDPELDNLMVKAIQVLRIHLLELEKVNELCKDFCNRYITCLKTKMHSDNLLRNDLGGPYSPNQPSINLHSQDLLQNSPNSMSGVSNNPQGIVVPASALQQGNIAMTTVNSQVVSGGALYQPVTMVTSQGQVVTQAIPQGAIQIQNTQVNLDLTSLLDNEDKKSKNKRGVLPKHATNIMRSWLFQHLMHPYPTEDEKRQIAAQTNLTLLQVNNWFINARRRILQPMLDASNPDPAPKAKKIKSQHRPTQRFWPNSIAAGVLQQQGGAPGTNPDGSINLDNLQSLSSDSATMAMQQAMMAAHDDSLDGTEEEDEDEMEEEEEEELEEEVDELQTTNVSDLGLEHSDSLE
